(12) United States Patent
Yu et al.

(10) Patent No.: US 12,053,514 B2
(45) Date of Patent: Aug. 6, 2024

(54) COMPOSITIONS OF A CARBOHYDRATE VACCINE FOR INDUCING IMMUNE RESPONSES AND USES THEREOF IN CANCER TREATMENT

(71) Applicant: OBI Pharma, Inc., Taipei (TW)

(72) Inventors: Cheng-Der Tony Yu, Taipei (TW); Cheng-Chi Irene Wang, Taipei (TW); Wei-Han Lee, Taipei (TW); Yu-Chen Lin, Taipei (TW); Yu-Hsin Tom Lin, Taipei (TW); I-Ju Chen, Taipei (TW)

(73) Assignee: OBI PHARMA, INC., Taipei (TW)

( * ) Notice: Subject to any disclaimer, the term of this patent is extended or adjusted under 35 U.S.C. 154(b) by 0 days.

(21) Appl. No.: 14/489,182

(22) Filed: Sep. 17, 2014

(65) Prior Publication Data

US 2015/0297696 A1    Oct. 22, 2015

Related U.S. Application Data

(60) Provisional application No. 61/878,982, filed on Sep. 17, 2013.

(51) Int. Cl.
*A61K 39/00* (2006.01)
*A61K 47/64* (2017.01)
*G01N 21/64* (2006.01)

(52) U.S. Cl.
CPC .... *A61K 39/001173* (2018.08); *A61K 47/643* (2017.08); *A61K 47/646* (2017.08); *G01N 21/64* (2013.01); *A61K 2039/55577* (2013.01); *A61K 2039/6081* (2013.01); *A61K 2039/627* (2013.01); *A61K 2039/64* (2013.01)

(58) Field of Classification Search
CPC .............. C07K 14/4748; A61K 39/011; A61K 31/00
See application file for complete search history.

(56) References Cited

U.S. PATENT DOCUMENTS

| | | | |
|---|---|---|---|
| 3,773,919 A | 11/1973 | Boswell et al. | |
| 4,203,975 A * | 5/1980 | Greven | A61P 25/28 514/17.7 |
| RE30,985 E | 6/1982 | Cartaya | |
| 4,419,446 A | 12/1983 | Howley et al. | |
| 4,522,811 A | 6/1985 | Eppstein et al. | |
| 4,560,655 A | 12/1985 | Baker | |
| 4,601,903 A | 7/1986 | Frasch | |
| 4,601,978 A | 7/1986 | Karin | |
| 4,657,866 A | 4/1987 | Kumar | |
| 4,676,980 A | 6/1987 | Segal et al. | |
| 4,767,704 A | 8/1988 | Cleveland et al. | |
| 4,816,567 A | 3/1989 | Cabilly et al. | |
| 4,849,222 A | 7/1989 | Broaddus | |
| 4,927,762 A | 5/1990 | Darfler | |
| 4,943,533 A | 7/1990 | Mendelsohn et al. | |
| 4,965,199 A | 10/1990 | Capon et al. | |
| 4,975,278 A | 12/1990 | Senter et al. | |
| 5,004,697 A | 4/1991 | Pardridge | |
| 5,057,540 A | 10/1991 | Kensil et al. | |
| 5,061,620 A | 10/1991 | Tsukamoto et al. | |
| 5,100,669 A | 3/1992 | Hyon et al. | |
| 5,112,596 A | 5/1992 | Malfroy-Camine | |
| 5,122,469 A | 6/1992 | Mather et al. | |
| 5,212,290 A | 5/1993 | Vogelstein et al. | |
| 5,264,365 A | 11/1993 | Georgiou et al. | |
| 5,268,164 A | 12/1993 | Kozarich et al. | |
| 5,500,362 A | 3/1996 | Robinson et al. | |
| 5,506,206 A | 4/1996 | Kozarich et al. | |
| 5,508,192 A | 4/1996 | Georgiou et al. | |
| 5,545,806 A | 8/1996 | Lonberg et al. | |
| 5,545,807 A | 8/1996 | Surani et al. | |
| 5,565,332 A | 10/1996 | Hoogenboom et al. | |
| 5,569,825 A | 10/1996 | Lonberg et al. | |
| 5,571,894 A | 11/1996 | Wels et al. | |

(Continued)

FOREIGN PATENT DOCUMENTS

| | | |
|---|---|---|
| CN | 1871025 A | 11/2006 |
| CN | 103108654 A | 5/2013 |

(Continued)

OTHER PUBLICATIONS

OBI Pharma, Inc. (NCT01516307 Clinical Trial Announcement, published Jan. 24, 2012) (Year: 2012).*
Gilewski (Proceedings of the National Academy of Sciences, vol. 98, No. 6, p. 3270-3275, 2001) (Year: 2001).*
Chen (J. Pharm. Biomed. Anal., vol. 48, No. 5, p. 1375-1380, 2008) (Year: 2008).*
Ragupathi (Glycoconjugate Journal, vol. 15, p. 217-221, 1998) (Year: 1998).*
Gebauer (Journal of Structural Biology, vol. 128, p. 280-286, 1999) (Year: 1999).*

(Continued)

*Primary Examiner* — Laura B Goddard
*Assistant Examiner* — Sarah A Alsomairy
(74) *Attorney, Agent, or Firm* — Prosyla Group PC

(57) ABSTRACT

The invention encompasses therapeutic compositions including Globo H-KLH conjugates and/or therapeutic antibodies as well as methods of making and using the same to treat proliferative diseases such as cancer. The therapeutic conjugates include an antigen linked to a carrier. In particular the therapeutic conjugates include a Globo H moiety and a KLH moiety and/or a derivatized KLH moiety subunit optionally linked via a linker. The therapeutic compositions are in part envisaged to act as cancer vaccines for boosting the body's natural ability to protect itself, through the immune system from dangers posed by damaged or abnormal cells such as cancer cells. An effective immune response is one that reduces the severity of disease, including but not limited to, prevention of disease, delay in onset of disease, decreased severity of symptoms, decreased morbidity and delayed mortality.

25 Claims, 135 Drawing Sheets

Specification includes a Sequence Listing.

(56) References Cited

U.S. PATENT DOCUMENTS

| | | | |
|---|---|---|---|
| 5,580,717 A | 12/1996 | Dower et al. | |
| 5,587,458 A | 12/1996 | King et al. | |
| 5,625,126 A | 4/1997 | Lonberg et al. | |
| 5,633,425 A | 5/1997 | Lonberg et al. | |
| 5,641,870 A | 6/1997 | Rinderknecht et al. | |
| 5,648,237 A | 7/1997 | Carter | |
| 5,661,016 A | 8/1997 | Lonberg et al. | |
| 5,686,416 A | 11/1997 | Kozarich et al. | |
| 5,733,743 A | 3/1998 | Johnson et al. | |
| 5,804,396 A | 9/1998 | Plowman | |
| 5,814,344 A | 9/1998 | Tice et al. | |
| 5,821,337 A | 10/1998 | Carter et al. | |
| 5,840,523 A | 11/1998 | Simmons et al. | |
| 5,869,046 A | 2/1999 | Presta et al. | |
| 5,891,996 A | 4/1999 | Mateo de Acosta del Rio et al. | |
| 6,004,940 A | 12/1999 | Marasco et al. | |
| 6,027,888 A | 2/2000 | Georgiou et al. | |
| 6,083,715 A | 7/2000 | Georgiou et al. | |
| 6,265,150 B1 | 7/2001 | Terstappen et al. | |
| 6,329,173 B1 | 12/2001 | Marasco et al. | |
| 6,524,584 B2 | 2/2003 | Kensil | |
| 6,544,952 B1 * | 4/2003 | Danishefsky | A61K 39/0011 424/184.1 |
| 6,703,019 B1 | 3/2004 | Malfroy-Camine | |
| 7,595,292 B2 | 9/2009 | Brocchini et al. | |
| 8,268,969 B2 | 9/2012 | Wong et al. | |
| 11,203,645 B2 | 12/2021 | Yu et al. | |
| 11,583,577 B2 | 2/2023 | Yu et al. | |
| 11,642,400 B2 | 5/2023 | Yu et al. | |
| 11,643,456 B2 | 5/2023 | Yu et al. | |
| 2002/0025313 A1 | 2/2002 | Micklus et al. | |
| 2002/0038086 A1 | 3/2002 | Hynynen et al. | |
| 2002/0065259 A1 | 5/2002 | Schatzberg et al. | |
| 2003/0073713 A1 | 4/2003 | Schoenhard | |
| 2003/0083299 A1 | 5/2003 | Ferguson | |
| 2003/0104402 A1 | 6/2003 | Zauderer et al. | |
| 2003/0129186 A1 | 7/2003 | Beliveau et al. | |
| 2003/0153492 A1 * | 8/2003 | Danishefsky | C07H 15/04 536/123 |
| 2003/0162695 A1 | 8/2003 | Schatzberg et al. | |
| 2004/0018194 A1 | 1/2004 | Francisco et al. | |
| 2004/0131692 A1 | 7/2004 | Kreuter et al. | |
| 2004/0204354 A1 | 10/2004 | Nelson et al. | |
| 2004/0208884 A1 | 10/2004 | Danishefsky et al. | |
| 2004/0229310 A1 | 11/2004 | Simmons | |
| 2004/0247608 A1 * | 12/2004 | Krantz | A61K 49/0004 530/395 |
| 2005/0048572 A1 | 3/2005 | Reilly et al. | |
| 2005/0089473 A1 | 4/2005 | Black et al. | |
| 2005/0124533 A1 | 6/2005 | Schatzberg et al. | |
| 2006/0035267 A1 | 2/2006 | Livingston et al. | |
| 2007/0059769 A1 | 3/2007 | Blixt et al. | |
| 2009/0317411 A1 | 12/2009 | Wong et al. | |
| 2010/0136042 A1 | 6/2010 | Wong et al. | |
| 2010/0166790 A1 | 7/2010 | Agadjanyan et al. | |
| 2010/0286035 A1 | 11/2010 | Ohtaki et al. | |
| 2011/0117009 A1 * | 5/2011 | Kratz | A61K 47/48192 424/1.11 |
| 2012/0237532 A1 * | 9/2012 | Olbrich | C07K 16/00 424/178.1 |
| 2012/0294859 A1 | 11/2012 | Goletz et al. | |
| 2012/0321583 A1 | 12/2012 | Yurkovetskiy et al. | |
| 2012/0328646 A1 | 12/2012 | Wong et al. | |
| 2013/0095173 A1 | 4/2013 | Danishefsky et al. | |
| 2013/0232589 A1 | 9/2013 | Papkoff et al. | |
| 2014/0363455 A1 | 12/2014 | Stull et al. | |
| 2015/0030669 A1 | 1/2015 | Platscher et al. | |
| 2015/0297696 A1 | 10/2015 | Yu et al. | |
| 2015/0316556 A1 | 11/2015 | Hardt et al. | |
| 2015/0344551 A1 | 12/2015 | Wong et al. | |
| 2016/0074522 A1 | 3/2016 | Okuda et al. | |
| 2016/0102151 A1 | 4/2016 | Wong et al. | |
| 2016/0339089 A1 | 11/2016 | Yu et al. | |
| 2017/0067885 A1 | 3/2017 | Yu et al. | |
| 2017/0101462 A1 | 4/2017 | Yu et al. | |
| 2017/0283488 A1 | 10/2017 | Yu et al. | |
| 2017/0304419 A1 | 10/2017 | Yu et al. | |
| 2018/0028629 A1 | 2/2018 | Yu et al. | |
| 2018/0030124 A1 | 2/2018 | Chen | |
| 2018/0193481 A1 | 7/2018 | Chang et al. | |
| 2018/0339061 A1 | 11/2018 | Yu et al. | |
| 2021/0228732 A1 | 7/2021 | Yu et al. | |

FOREIGN PATENT DOCUMENTS

| | | |
|---|---|---|
| EP | 0404097 A2 | 12/1990 |
| EP | 1391213 A1 | 2/2004 |
| EP | 2993182 A1 | 3/2016 |
| JP | 2006-507233 A | 3/2006 |
| JP | 2011524375 A | 9/2011 |
| JP | 2011524417 A | 9/2011 |
| JP | 2016500256 A | 1/2016 |
| JP | 2017507118 A | 3/2017 |
| JP | 2017525361 A | 9/2017 |
| KR | 10-2012-0014238 A | 2/2012 |
| WO | WO 87/00195 A1 | 1/1987 |
| WO | WO 90/03184 A1 | 4/1990 |
| WO | WO 90/03430 A1 | 4/1990 |
| WO | WO 91/00360 A1 | 1/1991 |
| WO | WO 91/10741 A1 | 7/1991 |
| WO | WO 92/00373 A1 | 1/1992 |
| WO | WO 92/09690 A2 | 6/1992 |
| WO | WO 93/01161 A1 | 1/1993 |
| WO | WO 93/06213 A1 | 4/1993 |
| WO | WO 93/07861 | 4/1993 |
| WO | WO 93/08829 A1 | 5/1993 |
| WO | WO 93/16185 A2 | 8/1993 |
| WO | WO 94/04690 A1 | 3/1994 |
| WO | WO 94/011026 A2 | 5/1994 |
| WO | WO 95/11010 | 4/1995 |
| WO | WO 96/07754 A1 | 3/1996 |
| WO | WO 96/11711 A1 | 4/1996 |
| WO | WO 96/30347 A1 | 10/1996 |
| WO | WO 96/33735 A1 | 10/1996 |
| WO | WO 96/33978 A1 | 10/1996 |
| WO | WO 96/33980 A1 | 10/1996 |
| WO | WO 96/34096 A1 | 10/1996 |
| WO | WO 96/40210 A1 | 12/1996 |
| WO | WO 97/38983 A1 | 10/1997 |
| WO | WO 98/24893 A2 | 6/1998 |
| WO | WO 98/36772 A1 | 8/1998 |
| WO | WO 98/43960 A1 | 10/1998 |
| WO | WO 99/06378 A1 | 2/1999 |
| WO | WO 99/06396 A1 | 2/1999 |
| WO | WO 99/09016 A1 | 2/1999 |
| WO | WO 99/042130 | 8/1999 |
| WO | WO 2000/41720 A1 | 7/2000 |
| WO | WO 2000/48630 A1 | 8/2000 |
| WO | WO-2000/49412 A1 | 8/2000 |
| WO | WO 2003/043583 A2 | 5/2003 |
| WO | WO 2003/077945 A1 | 9/2003 |
| WO | WO 2004/011476 A1 | 2/2004 |
| WO | WO 2004/032828 A2 | 4/2004 |
| WO | WO 2005/007197 A2 | 1/2005 |
| WO | WO 2006/105152 A2 | 10/2006 |
| WO | WO 2006/134423 A2 | 12/2006 |
| WO | WO 2007/026190 A2 | 3/2007 |
| WO | 2007047764 A2 | 4/2007 |
| WO | WO 2007/044515 | 4/2007 |
| WO | WO 2009/035494 A2 | 3/2009 |
| WO | WO 2009/126737 | 10/2009 |
| WO | 2010005735 A2 | 1/2010 |
| WO | 2010005735 A3 | 3/2010 |
| WO | WO 2011/156774 | 12/2011 |
| WO | WO-2011156774 A2 * | 12/2011 ......... A61K 39/0011 |
| WO | WO 2003/015796 A1 | 2/2012 |
| WO | WO 2014/107652 A2 | 7/2014 |
| WO | WO 2014/178195 A1 | 11/2014 |
| WO | 2015109180 A2 | 7/2015 |
| WO | WO 2015/143123 A2 | 9/2015 |
| WO | WO 2015/157629 A2 | 10/2015 |
| WO | WO 2015/159118 A2 | 10/2015 |
| WO | 2015157629 A3 | 12/2015 |

(56) References Cited

FOREIGN PATENT DOCUMENTS

| WO | WO 2016/026742 A1 | 2/2016 |
|---|---|---|
| WO | 2016044326 A1 | 3/2016 |
| WO | WO 2016/044326 A1 | 3/2016 |
| WO | 2016118961 A1 | 7/2016 |
| WO | WO 2016/118961 A1 | 7/2016 |
| WO | 2017004150 A1 | 1/2017 |
| WO | WO 2017/041027 A1 | 3/2017 |
| WO | 2017062792 A1 | 4/2017 |
| WO | WO 2017/062792 A1 | 4/2017 |
| WO | 2017172990 A1 | 10/2017 |
| WO | 2017185089 A2 | 10/2017 |
| WO | WO 2017/172990 A1 | 10/2017 |
| WO | 2018022933 A1 | 2/2018 |
| WO | WO 2018/022933 A1 | 2/2018 |
| WO | WO 2018/023121 A1 | 2/2018 |
| WO | 2018039274 A1 | 3/2018 |
| WO | 2018094414 A1 | 5/2018 |
| WO | WO 2018/094414 A1 | 5/2018 |
| WO | 2019232519 A1 | 12/2019 |

OTHER PUBLICATIONS

Wang et al (2000) (Polyclonal Antibodies from Patients Immunized with a Globo H-Keyhole Limpet Hemocyanin Vaccine: Isolation, Quantification, and Characterization of Immune Responses by Using Totally synthetic Immobilized Tumor Antigens, PNAS, vol. 97, 2001). (Year: 2000).*
NCT01516307 (Year: 2012).*
Wang et al (2000) (Polyclonal Antibodies from Patients Immunized with a Globo H-Keyhole Limpet Hemocyanin Vaccine: Isolation, Quantification, and Characterization of Immune Responses by Using Totally synthetic Immobilized Tumor Antigens, PNAS, vol. 97, 2001) (Year: 2001).*
Gilewski et al (2001) (Immunization of metastatic breast cancer patients with a fully synthetic globo H conjugate: A phase I trial, PNAS, 2001) (Year: 2001).*
NCT01516307 (2012). (Year: 2012).*
Wang et al (2000) (Polyclonal Antibodies from Patients Immunized with a Globo H-Keyhole Limpet Hemocyanin Vaccine: Isolation, Quantification, and Characterization of Immune Responses by Using Totally synthetic Immobilized Tumor Antigens, PNAS, vol. 97, 2001) (Year: 2001) (Year: 2001).*
Gilewski et al (2001) (Immunization of metastatic breast cancer patients with a fully synthetic globo H conjugate: A phase I trial, PNAS, 2001) (Year: 2001) (Year: 2001).*
NCT01516307 (2012). (Year: 2012) (Year: 2012).*
Ragupathi et al (1998) (A novel and efficient method for synethetic carbohydrate conjugate vaccine preparation synthesis of sialyl Tn-KLH conjugate using MMCCH linker arm, Glycoconjugate Journal (1998) 15: 217-221) (Year: 1998).*
Bergman, J. et al.: "Efficient Synthesis of 2-Chloro-, 2-Bromo-, and 2-Iodoindole," J. Org. Chem., vol. 57(8), pp. 2495-2497, 1992 [online], [retrieved on Nov. 18, 2015]. Retrieved from the internet <URL: http://pubis.acs.org/doi/abs/10.1021/jo00034a058>; p. 2495, col. 1, paragraph 4.
Hirano, F. et al.: "Blockade of B7-H1 and PD-1 by Monoclonal Antibodies Potentiates Cancer Therapeutic Immunity," Cancer Research, vol. 65(3), pp. 1089-1096, 2005 [online], [retrieved on Nov. 18, 2015]. Retrieved from the internet <URL: http://cancerres.aacrjournals.org/content/65/3/1089.full.pdf+html>; abstract, p. 1089, col. 1, paragraph 2.
Speed, M.A., et al.: "Multimeric Intermediates in the Pathway to the Aggregated Inclusion Body State for P22 Tailspike Polypeptide Chains," Protein Science, vol. 4, pp. 900-908, 1995 [online], [retrieved on Nov. 18, 2015]. Retrieved from the internet <URL: http://www.ncbi.inm.nih.gov/pmc/articles/PMC2143126/pdf/7663345.pdf>; abstract; p. 903, col. 1, paragraph 6.
Wakimoto, H., et al.: "Intensified Antitumor Immunity by a Cancer Vaccine That Produces Granulocyte-Macrophage Colony-Stimulating Factor Plus Interleukin $4^1$," Cancer Research, vol. 56, pp. 1828-1833, 1996 [online], [retrieved on Nov. 18, 2015]. Retrieved from the internet <URL: http://cancerres.aacrjournals.org/content/56/8/1828.full.pdf>; abstract; p. 1828, col. 2, paragraph 3; p. 1829, col. 2, paragraph 3.
International Search Report issued in International Patent Application No. PCT/IB2014/002744 dated Jan. 8, 2016.
First Office Action issued in Taiwan Patent Application No. 103131876, dated Dec. 26, 2016.
Search Report issued in Taiwan Patent Application No. 103131876, dated Dec. 20, 2016.
Teresa Gilewski et al., "Immunization of metastatic breast cancer patients with a fully synthetic globo H conjugate: A phase I trial", PNAS, Mar. 13, 2001, vol. 98, No. 6, pp. 3270-3275.
Avery, Oswald et al., "Chemo-Immunological Studies on Conjugated Carbohydrate-Proteins", J. Exp. Med., 1929, 50, pp. 533-550.
Berenbaum, M.C., "What is Synergy?", Pharmacol. Rev. 41(2), pp. 93-141, 1989.
Bliss, C.I., "The Calculation of Microbial Assays", Bacterial Rev. 20, pp. 243-258, 1956.
Borisy, Alexis et al., "Systematic Discovery of Multicomponent Therapeutics", Proc. Natl. Acad. Sci., 100(13), pp. 7977-7982, 2003.
Bremer, E.G. et al., "Characterization of a Glycosphingolipid Antigen Defined by the Monoclonal Antibody MBr1 Expressed in Normal and Neoplastic Epithelial Cells of Human Mammory Gland", J. Biol. Chem. 259, pp. 14773-14777, 1984.
Brüggemann et al., "Designer mice: the production of human antibody repertoires in transgenetic animals", Year in Immunol., 7, pp. 33-40, 1993.
Chang et al., "Potent immune-modulating and anticancer effects of NKT cell stimulatory glycolipids", Proc. Natl. Acad. Sci. USA, Jun. 19, 2007, 104(25), pp. 10299-10304.
Chou, T.C. and Talalay, P., "Quantitative Analysis of Dose-Effect Relationships: The Combined Effects of Multiple Drugs or Enzyme Inhibitors", Adv. Enzyme Regul, 22, pp. 27-55, 1984.
Chou, Ting-Chao and Talalay, Paul, "A Simple Generalized Equation for the Analysts of Multiple Inhibitions of Michaelis-Menten Kinetic Systems", J. Biol. Chem., 252: pp. 6438-6442, 1977.
Clackson et al., "Making antibody fragments using phage display libraries", Nature, Aug. 15, 1991, 352(6336), pp. 624-628.
Clynes R, et al., "Fc receptors are required in passive and active immunity to melanoma", Proc. Natl. Acad. Sci. U.S.A., Jan. 20, 1998, 95(2), pp. 652-656.
Cuzick et al., The Lancet, vol. 361, pp. 296-300, 2003.
Evans et al., Q. J. Med. 1999, 92, pp. 299-307.
Extended European Search Report for Application No. 15842660.1, dated Mar. 12, 2018.
Fellouse et al., "Synthetic antibodies from a four-amino-acid code: a dominant role for tyrosine in antigen recognition", Proc. Natl. Acad. Sci. U.S.A., Aug. 24, 2004, 101(34), pp. 12467-12472.
Fielder, R. J. et al., "An Immunogenic Polysaccharide-Protein Conjugate", J. Immunol., 1970, 105(1), pp. 265-267.
Fishwild et al., "High-avidity human IgGK monoclonal antibodies from a novel strain of minilocus transgenic mice", Nature Biotechnol. Jul. 1996, 14(7), pp. 845-851.
Fitzgerald, Jonathan et al., "Systems Biology and Combination Therapy in the Quest for Clinical Efficacy", Nature Chem. Biol., 2(9), pp. 458-466, 2006.
Gazzano-Santoro et al., "A non-radioactive complement-dependent cytotoxicity assay for anti-CD20 nonclonal antibody", J. Immunol. Methods, Mar. 28, 1997, 202(2), pp. 163-171.
Goebel, Walther et al., "Chemo-immunological Studies on Conjugated Carbohydrate-Proteins", J. Exp. Med., 1929, 50, pp. 521-531.
Greco, William et al., "The Search for Synergy: A Critical Review From a Response Surface Perspective", Pharmacol. Rev. 47(2), pp. 331-385, 1995.
Hammerling et al., "In: Monoclonal Antibodies and T-Cell Hybridomas", pp. 563-681, 1981.
Harris, "Production of humanized monoclonal antibodies for in vivo imaging and therapy", Biochem. Soc. Transactions, Nov. 1995, 23(4): pp. 1035-1038.

(56) References Cited

OTHER PUBLICATIONS

Harris, J. R. et al., "Keyhole Limpet Hemocyanin (KLH): a Biomedical Review", Micron, 30, 1999, pp. 597-623.
Heffernan, Biomaterials, vol. 32, pp. 926-932, 2011.
Hernandez-Ledesma, Peptides, vol. 30, pp. 426-430, 2009.
Himmelspach, K. et al., "Use of 1-(m-aminophenyl)flavazoles for the Preparation of Immunogens with Oligosaccharide Determinant Groups", Eur. J. Immunol., 1971, 1(2), pp. 106-112.
Huang, Cheng-Yuan et al., "Carbohydrate Microarray for Profiling the Antibodies Interacting with Globo H Tumor Antigen", Proc. Natl. Acad. Sci., 103, pp. 15-20, 2006.
Hurle et al., "Protein engineering techniques for antibody humanization", Curr. Opin. Biotechnol., Aug. 1994, 5(4), pp. 428-433.
International Search Report and Written Opinion of the International Searching Authority, PCT/US2015/050270, dated Sep. 15, 2015.
Jakobovits et al., "Analysis of homozygous mutant chimeric mice: deletion of the immunoglobulin heavy-chain joining region blocks B-cell development and antibody production", Proc. Natl. Acad. Sci. U.S.A, Mar. 15, 1993, 90(6), pp. 2551-2555.
Jakobovits et al., "Germ-line transmission and expression of a human-derived yeast artificial chromosome", Nature, Mar. 18, 1993, 362(6417), pp. 255-258.
Jones et al., "Replacing the complementarity-determining regions in a human antibody with those from a mouse", Nature, May 29-Jun. 4, 1986, 321(6069), pp. 522-525.
Köhler et al., "Continuous cultures of fused cells secreting antibody of predefined specificity", Nature, Aug. 7, 1975, 256(5517), pp. 495-497.
Komenaka et al., "Clinics in Dermatology", 2004, vol. 22, pp. 251-265.
Konecny, G. et al., "Drug Interactions and Cytotoxic Effects of Paclitaxel in Combination with Carboplatin, Epirubicin, Gemcitabine or Vinorelbine in Breast Cancer Cell Lines and Tumor Samples", Breast Cancer Res. and Treatment, 67, pp. 223-233, 2001.
Lee et al., "Bivalent antibody phage display mimics natural immunoglobulin", J. Immunol. Methods, Jan. 2004, 284(1-2), pp. 119-132.
Lee et al., "High-affinity human antibodies from phage-displayed synthetic Fab libraries with single framework scaffold", J. Mol. Biol., Jul. 23, 2004, 340(5), pp. 1073-1093.
Lonberg et al., "Antigen-specific human antibodies from mice comprising four distinct genetic modifications", Nature, Apr. 28, 1994, 368(6474), pp. 856-859.
Lonberg et al., "Human antibodies from transgenic mice", Int. Rev. Immunol., 1995, 13(1), pp. 65-93.
Marks et al., "By-passing immunization. Human antibodies from V-gene libraries displayed on phage", J. Mol. Biol., Dec. 5, 1991, 222(3), pp. 581-597.
Marks et al., "By-passing immunization: building high affinity human antibodies by chain shuffling", Nature Biotechnology, Jul. 1992, 10(7), pp. 779-783.
Martineau, R.S. et al., "Immunochemical Studies on a Panosyl-Azoprotein conjugate", Immunochemistry, vol. 8, pp. 705-718, 1971.
Morrison et al., "Chimeric human antibody molecules: mouse antigen-binding domains with human constant region domains", Proc. Natl. Acad. Sci. U.S.A., Nov. 1984, 81(21), pp. 6851-6855.
Morrison, "Immunology. Success in specification", Nature, Apr. 28, 1994, 368(6474), pp. 812-813.
Neuberger, "Generating high-avidity human Mabs in mice", Nature Biotechnol., Jul. 1996, 14(7), p. 826.
Nicolaou et al., "Calicheamicin ΘI1: A rationally designed molecule with extremely potent and selective DNA cleaving properties and apoptosis inducing activity", Angew. Chem. Intl. Ed. Engl., Feb. 1, 1994, 33(2), pp. 183-186.
OBI Pharma, Inc., NCT01516307 Clinical Trial Announcement, published Jan. 24, 2012.
Oxenius, Journal of Virology, vol. 73, No. 5, pp. 4120-4126, 1999.
Pegram, Mark et al., "Inhibitory Effects of Combinations of HER-2/neu Antibody and Chemotherapeutic Agents Used for Treatment of Human Breast Cancers", Oncogene, 18, pp. 2241-2251, 1999.
Pegram, Mark et al., "Rational Combinations of Trastuzumab With Chemotherapeutic Drugs Used in the Treatment of Breast Cancer", J. of the Nat. Cancer Inst., 96(10), pp. 739-749, 2004.
Presta, "Antibody engineering", Curr. Opin. Struct. Biol., Aug. 1992, 2(4), pp. 593-596.
Ragupathi, Govindaswami et al., "Immunization of Mice with a Fully Synthetic Globo H Antigen Results in Antibodies against Human Cancer Cells: A Combined Chemical-Immunological Approach to the Fashioning of an Anticancer Vaccine", Angew Chem. Int., 36(1-2), pp. 125-128, Feb. 1997.
Ravetch et al., "Fe receptors", Annu. Rev. Immunol., 1991, 9, pp. 457-492.
Riechmann et al., "Reshaping human antibodies for therapy", Nature, Mar. 24, 1988, 332(6162), pp. 323-327.
Rude, Erwin et al., "Synthesis of the N-Carboxy-α-Amino Acid Anhydrides of Several Acetylated Serine Glycosides", Carbohydr. Res., 1968, 8, p. 219.
Schiffman et al., The New England Journal of Medicine, vol. 353, No. 20, pp. 2101-2104, 2005.
Sidhu et al., "Phage-displayed antibody libraries of synthetic heavy chain complementarity determining regions", J. Mol. Biol., Apr. 23, 2004, 338(2), pp. 299-310.
Sigma-Aldrich, "Product Information for Hemocyanin From Megathura Crenulata", Catalog No. H7017, 1 Page, 2016.
Slovin, S.F. et al., "Carbohydrate Vaccines in Cancer: Immunogenicity of a Fully Synthetic Globo H Hexasaccharide Conjugate in Man", Proc. Natl. Acad. Sci., 96, pp. 5710-5715, May 1999.
Sun, Vaccine, vol. 21, pp. 849-855, 2003.
Toyokuni, Tatsushi et al., "Synthetic Vaccines: Synthesis of a Dimeric Tn Antigen-Lipopeptide Conjugate That Elicits Immune Responses Against Tn-Expressing Glycoproteins", J. Am. Chem. Soc., 1994, 116(1), pp. 395-396.
Vaswani et al., "Humanized antibodies as potential therapeutic drugs", Ann. Allergy, Asthma Immunol., Aug. 1998, 81(2), pp. 105-116, 119.
Wang et al., "Glycan microarray of Globo H and related structures for quantitative analysis of breast cancer", Proc. Natl. Acad. Sci. U.S.A., Aug. 19, 2008, 105(33), pp. 11661-11666.
Zhu, Jianglong et al., "From Synthesis to Biologics: Preclinical Data on a Chemistry Derived Anticancer Vaccine", J. Am. Chem. Soc., 131(26), pp. 9298-9303, 2009.
Abrahmsén et al, "Analysis of signals for secretion in the staphylococcal protein A gene," EMBO J., Dec. 30, 1985, 4(13B):3901-3906.
Allen, P. Z. et al., Immunochemical Studies on a Sophorosyl-Azoprotein Conjugate, Biochemistry, 1967, 6(10), 3029-3036.
Arié et al., "Chaperone function of FkpA, a heat shock prolyl isomerase, in the periplasm of *Escherichia coli*," Mol. Microbiol., Jan. 2001, 39(1):199-210.
Arigi, Emma, et al. "Design of a covalently bonded glycosphingolipid microarray." Glycoconjugate Journal 29.1 (2012): 1-12.
Bachmann, Cellular and Molecular Biology, vol. 2, Chapter 72: Derivations and Genotypes of Some Mutant Derivatives of *Escherichia coli* K-12, Neidhardt et al., eds., 1987, pp. 1190-1219, American Society for Microbiology, Washington, D.C.
Baldwin et al., "Monoclonal antibodies in cancer treatment," Lancet, Mar. 15, 1986, 327(8481):603-605.
Barbas et al., "Assembly of combinatorial antibody libraries on phage surfaces: the gene III site," Proc. Natl. Acad. Sci. U.S.A., Sep. 15, 1991, 88(18):7978-7982.
Barbas, C.F. et al., "Semisynthetic combinatorial antibody libraries: a chemical solution to the diversity problem" Proc. Natl. Acad. Sci. USA, May 15, 1992, 89(10):4457-4461.
Barbas et al., "In vitro evolution of a neutralizing human antibody to human immunodeficiency virus type 1 to enhance affinity and broaden strain cross-reactivity," Proc. Nat. Acad. Sci. U.S.A., Apr. 26, 1994, 91(9):3809-3813.
Barnes et al., "Methods for growth of cultured cells in serum-free medium," Anal. Biochem., Mar. 1, 1980, 102(2):255-270.

(56) References Cited

OTHER PUBLICATIONS

Bass et al., "Hormone phage: an enrichment method for variant proteins with altered binding properties," Proteins, 1990, 8(4):309-314.
Bertozzi, CR et al., Glycans in Cancer and Inflammation-Potential for Therapeutics and Diagnostics, Nat Rev Drug Discovery, 2005, 4, 477-488.
Bhaskar, Vinay, et al. "E-selectin up-regulation allows for targeted drug delivery in prostate cancer." Cancer Research 63.19 (2003): 6387-6394.
Bird, R.E., et al., "Single-chain antigen-binding proteins" Science Oct. 21, 1988;242(4877):423-426.
Bobo et al., "Convection-enhanced delivery of macromolecules in the brain," Proc. Natl. Acad. Sci. U.S.A., Mar. 15, 1994, 91(6) 2076-2080.
Boerner et al., "Production of antigen-specific human monoclonal antibodies from in vitro-primed human splenocytes," J. Immunol., Jul. 1, 1991, 147(1):86-95.
Bosse, Folkert et al., Linear Synthesis of the Tumor-Associated Carbohydrate Antigens Globo-H, SSEA-3, and Gb3, J Org Chem. 67(19):6659-70, 2002.
Bothmann et al., "The periplasmic *Escherichia coli* peptidylprolyl cis, trans-isomerase FkpA. I. Increased functional expression of antibody fragments with and without cis-prolines," J. Biol. Chem., Jun. 2, 2000, 275(22):17100-17105.
Bowie, JU et al., Deciphering the Message in Protein Sequences: Tolerance to Amino Acid Substitutions, Science, 247: 1306-1310 (1990).
Brennan et al., "Preparation of bispecific antibodies by chemical recombination of monoclonal immunoglobulin GI fragments," Science, Jul. 5, 1985, 229(4708):81-83.
Brodeur et al., Monoclonal Antibody Production Techniques and Applications, Chapter 4: Mouse-Human Myeloma Partners for the Production of Heterohybridomas, Schook, ed., 1987, pp. 51-63, Marcel Dekker, Inc., New York.
Carter et al., "High level *Escherichia coli* expression and production of a bivalent humanized antibody fragment," Nature Biotechnology, Feb. 1992, 10(2):163-167.
Carter et al., "Humanization of an anti-p185$^{HER2}$ antibody for human cancer therapy," Proc. Natl. Acad. Sci. U.S.A., May 15, 1992, 89(10):4285-4289.
Casset, Florence, et al. "A peptide mimetic of an anti-CD4 monoclonal antibody by rational design." Biochemical and Biophysical Research Communications 307.1 (2003):198-205.
Chang et al., "Expression of Globo H and SSEA3 in breast cancer stem cells and the involvement of fucosyl transferases 1 and 2 in Globo H synthesis," Proc. Natl. Acad. Sci. U.S.A., Aug. 19, 2008, 105(33):11667-11672.
Chen et al., "Chaperone activity of DsbC," J. Bio. Chem., Jul. 9, 1999, 274(28):19601-19605.
Chen et al., "Selection and analysis of an optimized anti-VEGF antibody: crystal structure of an affinity-matured Fab in complex with antigen," J. Mol. Biol., Nov. 5, 1999, 293(4):865-881.
Chen et al., "Selective killing of transformed cells by cyclin/cyclin-dependent kinase 2 antagonists," Proc. Natl. Acad. Sci. U.S.A., Apr. 13, 1999, 96(8):4325-4329.
Chen, Wei, et al. "Determination of thiols and disulfides via HPLC quantification of 5-thio-2-nitrobenzoic acid." Journal of Pharmaceutical and Biomedical Analysis 48.5 (2008): 1375-1380.
Cheung, Sarah et al., Stage-Specific Embryonic Antigen-3 (SSEA-3) and ß3GalT5 are cancer specific and Significant Markers for Breast Cancer Stem Cells, PNAS, Jan. 26, 2016, vol. 113, No. 4, pp. 960-965.
Chothia et al., "Canonical structures for the hypervariable regions of immunoglobulins," J. Mol. Biol., Aug. 20, 1987, 196(4):901-917.
Colman, P.M., "Effects of amino acid sequence changes on antibody-antigen interactions," Research in Immunology 145:33-36, 1994.
Cunningham et al., "High-resolution epitope mapping of hGH-receptor interactions by alanine-scanning mutagenesis," Science, Jun. 2, 1989, 244(4908):1081-1085.

Danishefsky, Samuel J., et al. "Development of Globo-H cancer vaccine." Accounts of Chemical Research 48.3 (2015): 643-652.
De Pascalis, Roberto, et al. "Grafting of "abbreviated" complementarity-determining regions containing specificity-determining residues essential for ligand contact to engineer a less immunogenic humanized monoclonal antibody." The Journal of Immunology 169.6 (2002): 3076-3084.
Doronina, Svetlana O., et al. "Development of potent monoclonal antibody auristatin conjugates for cancer therapy." Nature Biotechnology 21.7 (2003): 778-784.
Eller, Chelcie et al., Human Cancer Antigen Globo H Is a Cell-Surface Ligand for Human Ribonuclease 1, ACS Central Science. vol. 1, p. 181-90, Jul. 13, 2015.
Embleton et al., "In-cell PCR from mRNA: amplifying and linking the rearranged immunoglobulin heavy and light chain V-genes within single cells," Nucl. Acids Res., Aug. 11, 1992, 20(15):3831-3837.
Engels et al., "Gene synthesis [new synthetic methods (77)]," Angew. Chem. Int. Ed. Engl., Jun. 1989, 28(6):716-734.
Extended European Search Report from corresponding European App. No. 16843131.0, dated Feb. 14, 2019, 13 Pages.
Feng, Li. "Probing lipid-protein interactions using lipid microarrays." Prostaglandins & other lipid mediators 77.1-4 (2005): 158-167.
Francisco, Joseph A., et al. "cAC10-vcMMAE, an anti-CD30-monomethyl auristatin E conjugate with potent and selective antitumor activity." Blood 102.4 (2003): 1458-1465.
Galfrè et al., "Preparation of monoclonal antibodies: strategies and procedures," Methods Enzymol., 1981, 73(Pt B):3-46.
Gijsen, H.J. et al., Recent Advances in the Chemoenzymatic Synthesis of Carbohydrates and Carbohydrate Mimetics, Chem. Rev., 96, 443-473, 1996.
Gill et al., "Direct brain infusion of glial cell line-derived neurotrophic factor in Parkinson disease," Nature Med., May 2003, 9(5):589-595 and Addendum from Apr. 2006, 12(4):479.
Goding, Monoclonal Antibodies: Principles and Practice 2nd ed., Chapter 3: Production of Monoclonal Antibodies, 1986, pp. 59-103, Academic Press, London.
Gonnet, GH et al., Exhaustive Matching of the Entire Protein Sequence Database, Science 256: 1443-1445 (1992).
Graham et al., "Characteristics of a human cell line transformed by DNA from human adenovirus type 5," J. Gen. Virol., Jul. 1977, 36(1):59-72.
Gram et al., "In vitro selection and affinity maturation of antibodies from a naive combinatorial immunoglobulin library," Proc. Natl. Acad. Sci. U.S.A., Apr. 15, 1992, 89(8):3576-3580.
Grant, Oliver C., et al. "Presentation, presentation, presentation! Molecular-level insight into linker effects on glycan array screening data." Glycobiology 24.1 (2014): 17-25.
Griffiths et al., "Human anti-self antibodies with high specificity from phage display libraries," EMBO J., Feb. 1993, 12(2):725-734.
Gruber et al., "Efficient tumor cell lysis mediated by a bispecific single chain antibody expressed in *Escherichia coli*," J. Immunol., Jun. 1, 1994, 152(11):5368-5374.
Guss et al., "Structure of the IgG-binding regions of streptococcal protein G," EMBO J., Jul. 1986, 5(7):1567-1575.
Hakomori et al., "Glycosphingolipid antigens and cancer therapy," Chem. & Biol., Feb. 1997, 4(2):97-104.
Hakomori, Sen-Itiroh, Tumor-associated carbohydrate antigens defining tumor malignancy: Basis for development of and-cancer vaccines, 2001, Advances in Experimental Medicine and Biology. 491 :369-402.
Ham, Richard et al., Media and Growth Requirements, Meth. Enz 58, 44-93 (1979).
Hara et al., "Overproduction of penicillin-binding protein 7 suppresses thermosensitive growth defect at low osmolarity due to an spr mutation of *Escherichia coli*," Microbial Drug Resistance, Spring 1996, 2(1):63-72.
Harris, J. Robin, et al. "Keyhole limpet hemocyanin (KLH), II: Characteristic reassociation properties of purified KLH1 and KLH2." Micron 28.1 (1997): 43-56.

(56) References Cited

OTHER PUBLICATIONS

Hawkins et al., "Selection of phage antibodies by binding affinity. Mimicking affinity maturation," J. Mol. Biol., 1992, 226(3):889-896.

Hinman et al., "Preparation and characterization of monoclonal antibody conjugates of the calicheamicins: a novel and potent family of antitumor antibiotics," Cancer Res., Jul. 15, 1993, 53(14):3336-3342.

Hirabayashi, J. et al., Oligosaccharide Microarrays for Glycomics, Trends in Biotechnology 21 (4): 141-143, 2003.

Hogrefe, H.H. et al., "A bacteriophage lambda vector for the cloning and expression of immunoglobulin Fab fragments on the surface of filamentous phage" Gene, 1993, 128(1): 119-126.

Holliger et al., "'Diabodies': small bivalent and bispecific antibody fragments," Proc. Natl. Acad. Sci. U.S.A., Jul. 15, 1993, 90(14):6444-6448.

Holm, Patrik, Rozbeh Jafari, and Birgitta E. Sundström. "Functional mapping and single chain construction of the anti-cytokeratin 8 monoclonal antibody TS1." Molecular Immunology 44.6 (2007): 1075-1084.

Hoogenboom et al., "By-passing immunisation: Human antibodies from synthetic repertoires of germline VH gene segments rearranged in vitro," J. Mol. Biol., Sep. 20, 1992, 227(2):381-388.

Hoogenboom et al., "Multi-subunit proteins on the surface of filamentous phage: methodologies for displaying antibody (Fab) heavy and light chains," Nucl. Acids Res., Aug. 11, 1991 19(15):4133-4137.

Huang, Yen-Lin, and Chung-Yi Wu. "Carbohydrate-based vaccines: challenges and opportunities." Expert Review of Vaccines 9.11 (2010): 1257-1274.

Huang, Yen-Lin, et al. "Carbohydrate-based vaccines with a glycolipid adjuvant for breast cancer." Proceedings of the National Academy of Sciences 110.7 (2013): 2517-2522.

Huston, James et al, "Protein Engineering of Antibody Binding Sites: Recovery of Specific Activity in an Anti-Digoxin Single-Chain Fv Analogue Produced in *Escherichia coli*" Proc. Natl. Acad. Sci. USA, 1988, 85:5879-5883.

International Search Report and Written Opinion of the International Searching Authority, from corresponding International Patent Application No. PCT/US16/50252, dated Nov. 17, 2016, 12 Pages.

International Search Report and Written Opinion dated Jul. 7, 2017, from corresponding International Patent Application No. PCT/US2017/024853, by Yu, Cheng-Der Tony et al., "Antibodies, Pharmaceutical Compositions and Methods", filed Mar. 29, 2017, 21 pages.

International Search Report/Written Opinion dated Oct. 31, 2017 in counterpart PCT Application No. PCT/US2017/044244, 13 pages.

International Search Report dated Nov. 28, 2017 in counterpart application PCT/US2017/044713, 6 pages.

International Search Report/Written Opinion dated Mar. 12, 2018 in counterpart PCT Application No. PCT/US17/062886, 22 pages.

Jackson et al., "In vitro antibody maturation: Improvement of a high affinity, neutralizing antibody against IL-1B," J. Immunol., Apr. 1, 1995, 154(7):3310-3319.

Jeon, Insik et al., A Practical Total Synthesis of Globo-H for Use in Anticancer Vaccines, J. Org. Chem., 2009, 74(21), pp. 8452-8455.

Jones et al., "Rapid PCR-cloning of full-length mouse immunoglobulin variable regions," Nature Biotechnol., Jan. 1991, 9(1):88-89.

Jones, "Analysis of polypeptides and proteins," Adv. Drug Delivery Rev., Jan.-Apr. 1993, 10(1):29-90.

Kam et al., "Carbon nanotubes as multifunctional biological transporters and near-infrared agents for selective cancer cell destruction," Proc. Natl. Acad. Sci. U.S.A., Aug. 16, 2005, 102(33):11600-11605.

Kannagi, Reiji, et al. "Stage-specific embryonic antigens (SSEA-3 and -4) are epitopes of a unique globo-series ganglioside isolated from human teratocarcinoma cells." EMBO Journal 2.12 (1983): 2355-2361.

Kannagi et al., "New globoseries glycosphingolipids in human teratocarcinoma reactive with the monoclonal antibody directed to a developmentally regulated antigen, stage-specific embryonic antigen 3," J. Biol. Chem., Jul. 25, 1983, 258(14):8934-8942.

Klussman, Kerry, et al. "Secondary mAb-vcMMAE conjugates are highly sensitive reporters of antibody internalization via the lysosome pathway." Bioconjugate chemistry 15.4 (2004): 765-773.

Koeller, Kathryn et al., Enzymes for Chemical Synthesis, Nature, 409, 232-240, 2001.

Kontermann, "Intrabodies as therapeutic agents," Methods, Oct. 2004, 34(2):163-170.

Kostelny et al., "Formation of a bispecific antibody by the use of leucine zippers," J. Immunol., Mar. 1, 1992, 148(5):1547-1553.

Kozbor, "A human hybrid myeloma for production of human monoclonal antibodies," J. Immunol., Dec. 1984, 133(6):3001-3005.

Krainer, Florian et al., An Updated View on Horseradish Peroxidases: Recombinant Production and Biotechnological Applications, Applied Microbiology and Biotechnology, vol. 99, p. 1611-1625, Jan. 11, 2015.

Kufer, Peter, et al. "A revival of bispecific antibodies." Trends in biotechnology 22.5 (2004): 238-244.

Lee et al. "Immunogenicity study of Globo H analogues with modification at the reducing or nonreducing end of the tumor antigen" Journal of the American Chemical Society, (2014) 136(48), 16844-16853.

Lehninger, Biochemistry: The Molecular Basis of Cell Structure and Function, 2nd ed., 1975, pp. 73-75, Worth Publishers, New York.

Leung et al., "A method for random mutagenesis of a defined DNA segment using a modified polymerase chain reaction," Technique—A Journal of Methods in Cell and Molecular Biology, Aug. 1989, 1(1):11-15.

Liang, Pi-Hui, et al. "Quantitative Microarray Analysis of Intact Glycolipid—CD1d Interaction and Correlation with Cell-Based Cytokine Production." Journal of the American Chemical Society 130.37 (2008): 12348-12354.

Lindmark et al., "Binding of immunoglobulins to protein A and immunoglobulin levels in mammalian sera," J. Immunol. Meth., Aug. 12, 1983, 62(1):1-13.

Liu et al., "Eradication of large colon tumor xenografts by targeted delivery of maytansinoids," Proc. Natl., Acad. Sci. U.S.A., Aug. 6, 1996, 93(16):8618-8623.

Liu, Gui, et al. "QS-21 structure/function studies: effect of acylation on adjuvant activity." Vaccine 20.21-22 (2002): 2808-2815.

Livingston, Philip, "Augmenting the immunogenicity of carbohydrate tumor antigens" Seminars in Cancer Biology, Cancer Biol, 6(6):357-366, 1995.

Lloyd, Kenneth, "Tumor Antigens Known to be Immunogenic in Man" in Specific Immunotherapy of Cancer with Vaccines, 1993, 690, 50-58.

Lode et al., "Targeted therapy with a novel enediyene antibiotic calicheamicin 911 effectively suppresses growth and dissemination of liver metastases in a syngeneic model of murine neuroblastoma," Cancer Res., Jul. 15, 1998, 58(14):2925-2928.

Lou, et al., Stage-specific embryonic antigent-4 as a potential therapeutic target in glioblastoma multiforms and other cancers. Proc Natl Acad Sci USA 2014, 111(7):2482-7.

Lucas, A.H. et al., Carbohydrate Moieties as Vaccine Candidates: Meeting Summary, Vaccine, vol. 28(4), Jan. 2010, pp. 1121-1131.

Mandler et al., "Immunoconjugates of geldanamycin and anti-HER2 monoclonal antibodies: antiproliferative activity on human breast carcinoma cell lines," J. Nat. Cancer Inst., Oct. 4, 2000, 92(19):1573-1581.

Mandler et al., "Modifications in synthesis strategy improve the yield and efficacy of geldanamycin-herceptin immunoconjugates," Bioconjugate Chem., Jul.-Aug. 2002, 13(4):786-791.

Mandler et al., "Synthesis and evaluation of antiproliferative activity of a geldanamycin-Herceptin™ immunoconjugate," Bioorganic & Med. Chem. Letters, May 15, 2000, 10(10):1025-1028.

Mao, Shenlan, et al. "Phage-display library selection of high-affinity human single-chain antibodies to tumor-associated carbohydrate

(56) References Cited

OTHER PUBLICATIONS antigens sialyl Lewisx and Lewisx." Proceedings of the National Academy of Sciences 96.12 (1999): 6953-6958.
Mao, Weiguang, et al. "EphB2 as a therapeutic antibody drug target for the treatment of colorectal cancer." Cancer Research 64.3 (2004): 781-788.
Marasco et al., "Design, intracellular expression, and activity of a human anti-human immunodeficiency virus type 1 gp120 single-chain antibody," Proc. Natl. Acad. Sci. U.S.A., Aug. 15, 1993, 90(16):7889-7893.
Marasco, "Intrabodies: turning the humoral immune system outside in for intracellular immunization," Gene Therapy, Jan. 1997, 4(1):11-15.
Mather et al., "Culture of testicular cells in hormone-supplemented serum-free medium," Annals N.Y. Acad. Sci., 1982, 383:44-68.
Mather, "Establishment and characterization of two distinct mouse testicular epithelial cell lines," Biol. Reprod., Aug. 1980, 23(1):243-252.
Matsuda, F. et al., "Structure and physical map of 64 variable segments in the 3' 0.8-megabase region of the human immunoglobulin heavy-chain locus." Nature Genet., 1993, 3: 88-94.
McCafferty et al., "Phage antibodies: Filamentous phage displaying antibody variable domains," Nature, Dec. 6, 1990, 348:552-554.
Menard S et al., Generation of Monoclonal Antibodies Reacting with Normal and Cancer Cells of Human Breast, Cancer Res 43: 1295-1300, 1983.
Miller, Kathy, et al. "Design, construction, and in vitro analyses of multivalent antibodies." The Journal of Immunology 170.9 (2003): 4854-4861.
Milstein, C & Cuello, AC, Hybrid Hydridomas and their use in immunohistochemistry, Nature 305, 537-540, Oct. 1993.
Morimoto et al., "Single-step purification of F(ab')2 fragments of mouse monoclonal antibodies (immunoglobulins G1) by hydrophobic interaction high performance liquid chromatography using TSKgel Phenyl-5PW," J. Biochem. Biophys. Meth., Mar. 1992, 24(1-2):107-117.
Munson et al., "Ligand: a versatile computerized approach for characterization of ligand-binding systems," Anal. Biochem., Sep. 1, 1980, 107(1):220-239.
Neuberger et al., "Recombinant antibodies possessing novel effector functions," Nature, Dec. 13-19, 1984, 312(5995):604-608.
Niculescu-Duvaz et al., "Antibody-directed enzyme prodrug therapy (ADEPT): A review," Adv. Drg. Del. Rev., Jul. 7, 1997, 26(2-3):151-172.
Nikula, Kristen et al., Animal Models of Chronic Bronchitis and Their Relevance to Studies of Particle-Induced Disease, Inhal. Toxicol. 4(12): 123-153, 2000.
Orlandi et al., "Cloning immunoglobulin variable domains for expression by the polymerase chain reaction," Proc. Natl. Acad. Sci. U.S.A., May 1989, 86(10):3833-3837.
Ørum et al., "Efficient method for constructing comprehensive murine Fab antibody libraries displayed on phage." Nucleic Acids Res., Sep. 25, 1993, 21(19):4491-4498.
Papanastassiou et al., "The potential for efficacy of the modified (ICP 34.5-) herpes simplex virus HSV1716 following intratumoural injection into human malignant glioma: a proof of principle study," Gene Therapy, Mar. 2002, 9(6):398-406.
Paul, William E. "Structure and Function of Immunoglobulins, Fundamental Immunology." Chapter 9 (1993), 3rd Edition: 292-295.
Pearson, William, Using the FASTA Program to Search Protein and DNA Sequence Databases, Methods Mol. Biol. 243:307-331, 1994.
PLückthun, "Mono- and bivalent antibody fragments produced in Escherichia coli: Engineering, folding and antigen binding," Immunol. Rev., Dec. 1992, 130:151-188.
PLückthun, Handbook of Experimental Pharmacology, vol. 113: The Pharmacology of Monoclonal Antibodies, Chapter 11: Antibodies from Escherichia coli, Rosenberg et al., eds., 1994, pp. 269-315, Springer-Verlag, Berlin.

Presta et al., "Humanization of an antibody directed against IgE," J. Immunol., Sep. 1, 1993, 151(5):2623-2632.
Presta et al., "Humanization of an anti-vascular endothelial growth factor monoclonal antibody for the therapy of solid tumors and other disorders," Cancer Res., Oct. 15, 1997, 57(20):4593-4599.
Presta, Leonard G. "Antibody engineering." Current Opinion in Biotechnology 3.4 (1992): 394-398.
Proba et al., "Functional antibody single-chain fragments from the cytoplasm of Escherichia coli: influence of thioredoxin reductase (TrxB)," Gene, Jul. 4, 1995, 159(2):203-207.
Queen, Cary et al, A Humanized Antibody that Binds to the Interleukin 2 Receptor, Proc Natl Acad Sci., 86: 10029-10033 (1989).
Ragupathi, Govindaswami, et al. "Constructing an adenocarcinoma vaccine: Immunization of mice with synthetic KH-1 nonasaccharide stimulates anti-KH-1 and anti-Ley antibodies." International Journal of Cancer 99.2 (2002): 207-212.
Ramm et al., "The periplasmic Escherichia coli peptidylprolyl cis, trans-isomerase FkpA. II. Isomerase-independent chaperone activity in vitro," J. Biol. Chem., Jun. 2, 2000, 275(22):17106-17113.
Reyes et al., "Expression of human β-interferon cDNA under the control of a thymidine kinase promoter from herpes simplex virus," Nature, Jun. 17, 1982, 297(5867):598-601.
Rowland et al., "Drug localisation and growth inhibition studies of vindesine- monoclonal anti-CEA conjugates in a human tumour xenograft," Cancer Immunol. Immunother., 1986, 21(3):183-187.
Rudikoff, Stuart, et al. "Single amino acid substitution altering antigen-binding specificity." Proceedings of the National Academy of Sciences 79.6 (1982): 1979-1983.
Sastry et al., "Cloning of the immunological repertoire in Escherichia coli for generation of monoclonal catalytic antibodies: construction of a heavy chain variable region-specific cDNA library," Proc. Natl. Acad. Sci. U.S.A., Aug. 1989, 86(15):5728-5732.
Schier et al., "Identification of functional and structural amino-acid residues by parsimonious mutagenesis," Gene, Mar. 9, 1996, 169(2):147-155.
Schwarz, Mikael, et al. "A new kind of carbohydrate array, its use for profiling antiglycan antibodies, and the discovery of a novel human cellulose-binding antibody." Glycobiology 13.11 (2003): 749-754.
Sedlik, Christine et al., Effective Antitumor Therapy Based on a Novel Antibody-Drug Conjugate Targeting the Tn Carbohydrate Antigen, Oncoimmunology, Jul. 2016, vol. 5, No. 7, e1171434-1-13.
Shalaby et al., "Development of humanized bispecific antibodies reactive with cytotoxic lymphocytes and tumor cells overexpressing the HER2 protooncogene," J. Exp. Med., Jan. 1, 1992, 175(1):217-225.
Siebenlist et al., "E. coli RNA polymerase interacts homologously with two different promoters," Cell, Jun. 1980, 20(2):269-281.
Simmons et al., "Expression of full-length immunoglobulins in Escherichia coli: Rapid and efficient production of aglycosylated antibodies," J. Immunol. Methods, May 1, 2002, 263(1-2):133-147.
Sims et al., "A humanized CD18 antibody can block function without cell destruction," J. Immunol., Aug. 15, 1993, 151(4):2296-2308.
Sjölander, A., et al. "ISCOMs: an adjuvant with multiple functions." J. Leukocyte Biol. 64.6 (1998): 713-723.
Skerra, "Bacterial expression of immunoglobulin fragments," Curr. Opinion in Immunol., Apr. 1993, 5(2):256-262.
Sonderstrup, Grete, Development of Humanized Mice as a Model of Inflammatory Arthritis, Springer Sem. Immunopathol. 25: 35-45, 2003.
Suresh et al., "Bispecific monoclonal antibodies from hybrid hybridomas," Methods in Enzymology, 1986, 121:210-228.
Syrigos et al., "Antibody directed enzyme prodrug therapy (ADEPT): a review of the experimental and clinical considerations," Anticancer Research, Jan.-Feb. 1999, 19(1A):605-614.
Takeda et al., "Construction of chimaeric processed immunoglobulin genes containing mouse variable and human constant region sequences," Nature, Apr. 4-10, 1985, 314(6010):452-454.

(56) References Cited

OTHER PUBLICATIONS

Thorpe, (1985) "Antibody Carriers of Cytotoxic Agents in Cancer Therapy: A Review," in Monoclonal Antibodies '84: Biological and Clinical Applications, A. Pinchera et al. (Ed.s), pp. 475-506.
Tomlinson, I.M. et al., "The repertoire of human germline VH sequences reveals about fifty groups of VH segments with different hypervariable loops" J. Mol. Biol., Oct. 5, 1992, 227(3): 776-798.
Traunecker et al., "Bispecific single chain molecules (Janusins) target cytotoxic lymphocytes on HIV infected cells," EMBO J., Dec. 1991, 10(12):3655-3659.
Tutt et al., "Trispecific F(ab')$_3$ derivatives that use cooperative signaling via the TCR/CD3 complex and CD2 to activate and redirect resting cytotoxic T cells," J. Immunol., Jul. 1, 1991, 147(1):60-69.
Urlaub et al., "Isolation of Chinese hamster cell mutants deficient in dihydrofolate reductase activity." Proc. Natl. Acad. Sci. U.S.A., Jul. 1980, 77(7):4216-4220.
Vajdos, Felix F., et al. "Comprehensive functional maps of the antigen-binding site of an anti-ErbB2 antibody obtained with shotgun scanning mutagenesis." Journal of Molecular Biology 320.2 (2002): 415-428.
Verhoeyen et al., "Reshaping human antibodies: grafting an antilysozyme activity," Science, Mar. 25, 1988, 239(4847):1534-1536.
Wallner, Fredrik K., et al. "Solid-phase synthesis of serine-based glycosphingolipid analogues for preparation of glycoconjugate arrays." Organic & Biomolecular Chemistry 3.2 (2005): 309-315.
Ward et al., "Binding activities of a repertoire of single immunoglobulin variable domains secreted from *Escherichia coli*," Nature, Oct. 12, 1989, 341(6242):544-546.
Waterhouse et al., "Combinatorial infection and in vivo recombination: a strategy for making large phage antibody repertoires," Nuc. Acids Res., May 11, 1993, 21(9):2265-2266.
Wilen et al., "Strategies in optical resolutions," Tetrahedron, 1977, 33(21):2725-2736.
Williams, S.C. and Winter, G. "Cloning and sequencing of human immunoglobulin $V_\lambda$ gene segments" Eur. J. Immunol., 1993, 23: 1456-1461.
Wilman, "Prodrugs in Cancer Chemotherapy" Biochemical Society Transactions, 14, pp. 375-382, 615th Meeting Belfast, 1986.
Winter et al., "Making antibodies by phage display technology," Annu. Rev. Immunol., 1994, 12:433-455.
Wymer, Nathan et al., Enzyme-Catalyzed Synthesis of Carbohydrates, Curr. Opin. Chem. Biol., 4, 110-119, 2000.
Yaniv, Moshe, Enhancing Elements for Activation of Eukaryotic Promoters, Nature 297: 17-18, 1982.
Yansura et al., "Nucleotide sequence selection for increased expression of heterologous genes in *Escherichia coli*," Methods: A Companion to Methods in Enzymol., Aug. 1992, 4(2):151-158.
Yelton et al., "Affinity maturation of the BR96 anti-carcinoma antibody by codon-based mutagenesis." J. Immunol., Aug. 15, 1995, 155(4):1994-2004.
Zhang et al., "Selection of tumor antigens as targets for immune attack using immunohistochemistry: I. Focus on gangliosides," Int. J. Cancer, Sep. 26, 1997,73(1):42-49.
Zhou, Zhifang et al., A Fully Synthetic Self-Adjuvanting Globo H-Based Vaccine Elicited Strong T Cell-Mediated Antitumor Immunity, Chem. Sci., 2015, 6, 7112-7121.
Eller, Chelcie et al., "Affinity of monoclonal antibodies for Globo-series glycans," Carbohydrate Research, (2014), 397, 1-6.
Lin, Yuan et al., "Improved affinity of a chicken single-chain antibody to avian infectious bronchitis virus by site-directed mutagenesis of complementarity-determining region H3", African Journal of Biotechnology, vol. 10(79), pp. 18294-18302, Dec. 12, 2011.
Lou, Yi-Wei et al., "Stage-specific embryonic antigen-4 as a potential therapeutic target in glioblastoma multiforme and other cancers," PNAS, (2014), 111(7): 2482-2487.
Mariuzza, R.A. et al., "The Structural Basis of Antigen-Antibody Recognition", Ann. Rev. Biophys. Chem, 1987, vol. 16, pp. 139-159.
McCarthy, Barry J., et al. "Altering the find specificity of an anti-Legionella single chain antibody by a single amino acid insertion", Journal of Immunological Methods, 2001, vol. 251, pp. 137-149.
Chang, W.W. et al., "Expression of Globo H and SSEA3 in breast cancer stem cells and the involvement of fucosyl transferases 1 and 2 in Globo H synthesis," PNAS, Aug. 19, 2008, vol. 105 No. 33, pp. 11667-11672.
Genbank: CAG28308.1, May 13, 2004.
Genbank: CAG28309.2, Nov. 26, 2013.
Murphy, Caroline et al., "Enhancing recombinant antibody performance by optimally engineering its format," J. of Immunological Methods, (2018), 468:127-133.
Pravetoni, M et al. "Structurally distinct nicotine immunogens elicit antibodies with non-overlapping specificities," Biochem Pharmacol, Feb. 15, 2012, vol. 83. No. 4, 543-550. 19 pages.
Sledzinska, Anna et al. "Negative immune checkpoints on T lymphocytes and their relevance to cancer immunotherapy," Molecular Oncology, 2015, vol. 9, pp. 1936-1965 (30 pages).
International Search Report dated Mar. 24, 2022, in International Patent Publication No. WO 2022/072513.
Ragupathi, G., et al., "A fully synthetic globo H carbohydrate vaccine induces a focused humoral response in prostate cancer patients: a proof of principle," Angewandte Chemie International Edition 38.4 (1999): 569-566. Feb. 24, 1999.
Chang, Wen-Wei et al., "Expression of Globo H and SSEA3 in breast cancer stem cells and the involvement of fucosyl transferases 1 and 2 in Globo H synthesis," PNAS, 2008, vol. 105, N.33, pp. 11667-11672.
U.S. Appl. No. 17/595,830, filed Nov. 24, 2021, Cheng-Der Tony Yu.
Gilewski et al, "Immunization of Metastatic Breast Cancer Patients with a Fully Synthetic Globo H Conjugate: a Phase I Trial," PNAS, 98(6):3270-5, Mar. 13, 2001.
Johnson C. Bryce et al., "Combination therapy with PD-1/PD-L1 blockade: An overview of ongoing clinical trials," OncoImmunology, Mar. 13, 2018, vol. 7, No. 4, e1408744.
Bioconjugate Techniques (Third edition), 2013; pp. 839-865, Chapter 19-Vaccines and Immunogen Conjugates.
Cheung, Sarah K. C. et al., "Stage-specific embryonic antigen-3 (SSEA-3) and beta3GalT5 are cancer specific and significant markers for breast cancer stem cells", PNAS, (Jan. 26, 2016), vol. 113, No. 4, pp. 960-965, DOI: http://dx.doi.org/10.1073/pnas.1522602113.
Sedlik, Christine et al., "Effective antitumor therapy based on a novel antibody-drug conjugate targeting the Tn carbohydrate antigen", Oncoimmunology, (Apr. 22, 2016), vol. 5, No. 7, pp. 1-13, DOI: http://dx.doi.org/10.1080/2162402X.2016.1171434.
Slovin et al., "Carbohydrate vaccines in cancer: Immunogenicity of a fully synthetic globo H hexasaccharide conjugate in man," PNAS, (1999), vol. 96, pp. 5710-5715.

* cited by examiner

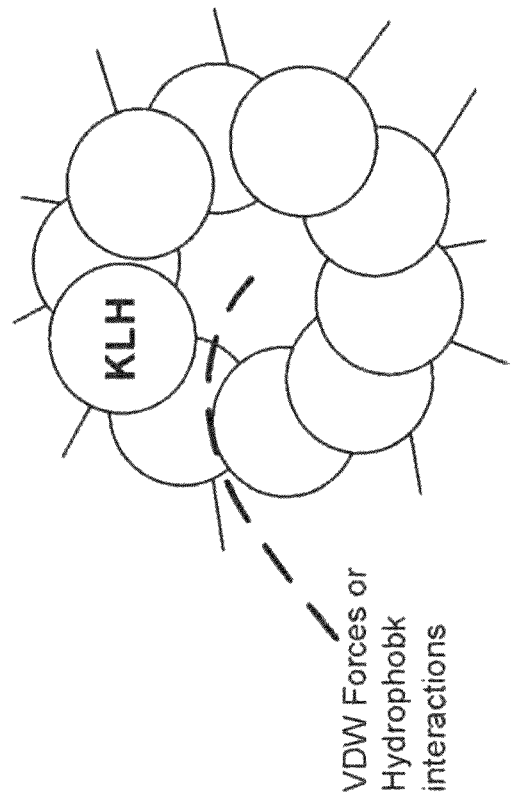
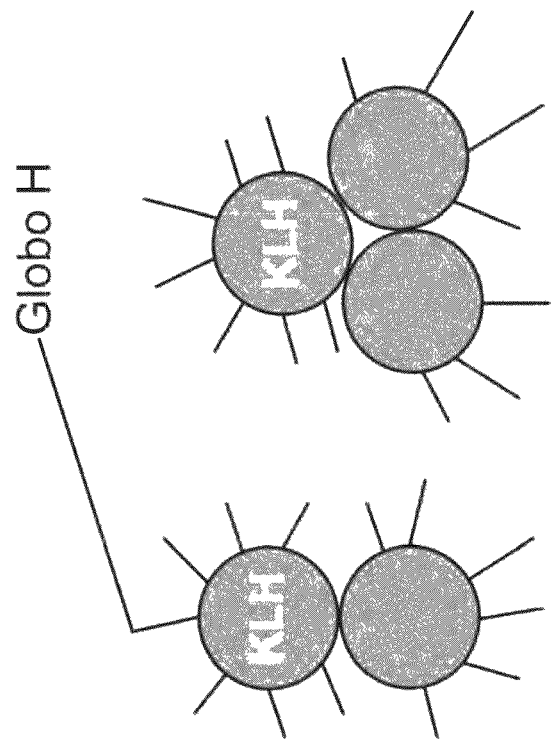
Fig. 2B

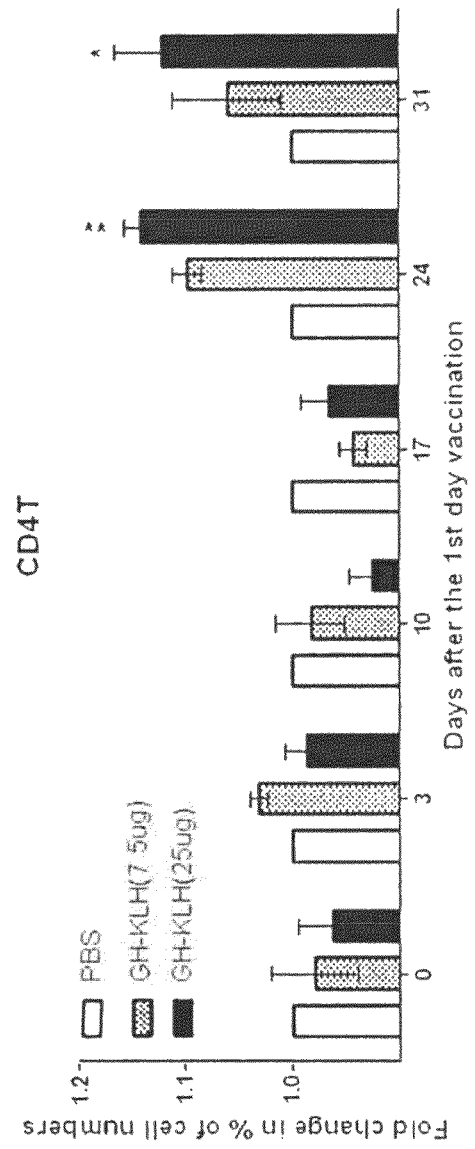

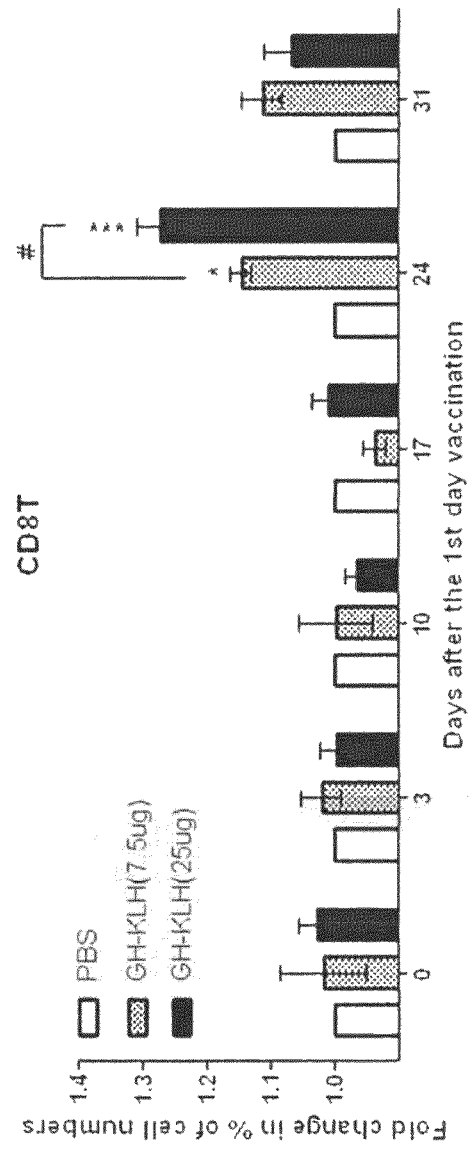

Figure 6
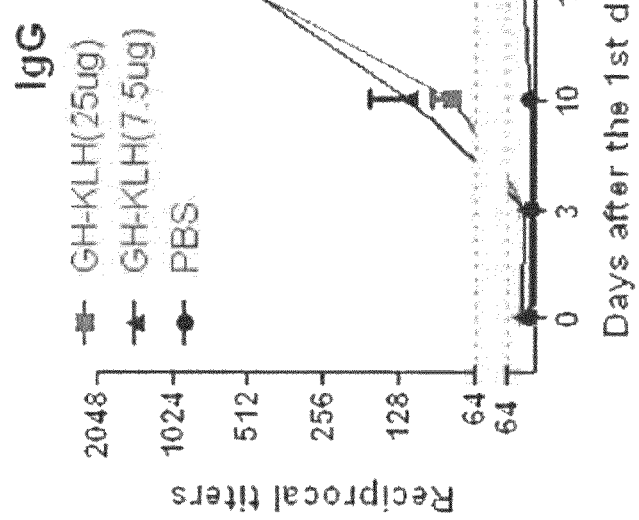
Figure 6B
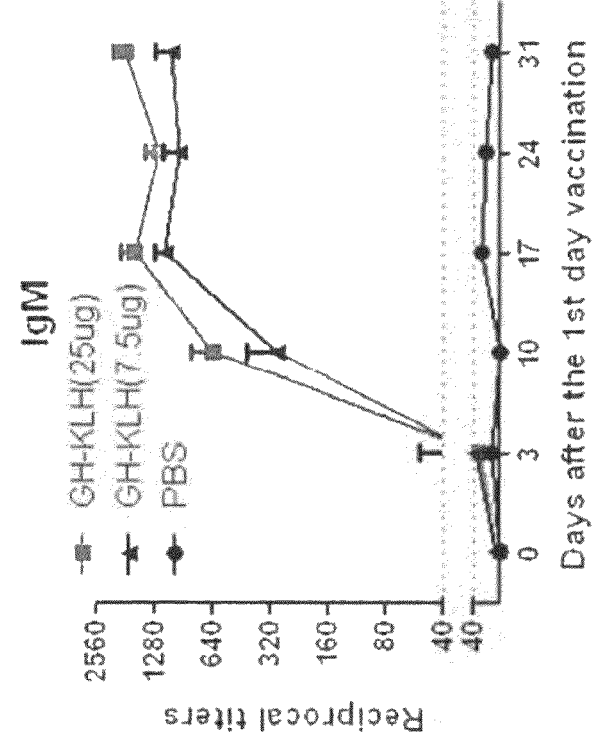
Figure 6A

Immunogenicity Experiment: Globo H-KLH Vaccine Immunization in C57BL/6 Mice

Figure 13

| Sample | 1st LC-MS/MS | 2nd LC-MS/MS |
|---|---|---|
| 1 | Table 2. | Table 6. |
| 2 | Table 3. | Table 7. |
| 3 | Table 4. | Table 8. |
| 4 | Table 5. | Table 9. |

Table 1B. MMCCH derivative analysis

| Sample | 1st LC-MS/MS | 2nd LC-MS/MS |
|---|---|---|
| 1 | Table 10. | Table 14. |
| 2 | Table 11. | Table 15. |
| 3 | Table 12. | Table 16. |
| 4 | Table 13. | Table 17. |

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 142 | 149 | 847.4247 | 1692.8349 | 1692.8240 | 6.44 | T | 1 | 17 | 0.02 | KNINDLTR +K_MMCCH_NL673 (K) | 142 |
| 2 | 157 | 166 | 851.9063 | 1701.7981 | 1701.7933 | 2.82 | T | 1 | 14 | 0.039 | EAFHKFQEDR +K_MMCCH_NL997 (K) | 161 |
| 3 | 588 | 606 | 1132.8336 | 3395.4790 | 3395.4862 | -2.09 | T | 1 | 16 | 0.022 | EDKSAGGFQQLGAFHGEPK +Globo_H_MMCCH (K) | 590 |
| 4 | 700 | 719 | 1015.1623 | 3042.4652 | 3042.4532 | 3.94 | T | 1 | 27 | 0.0019 | SVQNKLFEQPEFGHYTSIAK +K_MMCCH_NL673 (K) | 719 |
| 5 | 953 | 965 | 762.7177 | 2285.1311 | 2285.1249 | 2.71 | T | 1 | 52 | 6.30E-06 | DLFKQPSVIHEPR +K_MMCCH_NL673 (K) | 956 |
| 6 | 986 | 1000 | 1036.8300 | 3107.4681 | 3107.4578 | 3.31 | T | 1 | 20 | 0.011 | KNIENLSLGELESLR +Globo_H_MMCCH (K) | 986 |
| 7 | 1092 | 1114 | 806.3826 | 3221.5014 | 3221.5213 | -6.18 | T | 1 | 24 | 0.0038 | QHHYETNPFHHGKITHENEITR +K_MMCCH_NL997 (K) | 1104 |
| 8 | 1473 | 1489 | 905.7906 | 2714.3499 | 2714.3414 | 3.13 | T | 1 | 25 | 0.0034 | KHGAVVGLPYWDWTLPR +K_MMCCH_NL673 (K) | 1473 |
| 9 | 1923 | 1932 | 793.8990 | 1585.7834 | 1585.7745 | 5.68 | T | 1 | 17 | 0.02 | NKVMPNPFAR +Deamidated (NQ); K_MMCCH_NL997 (K); Oxidation (M) | 1924 |
| 10 | 2359 | 2367 | 846.4022 | 1690.7898 | 1690.7872 | 1.54 | T | 1 | 19 | 0.011 | DKLFNDPER +K_MMCCH_NL835 (K) | 2360 |
| 11 | 2851 | 2883 | 1027.9812 | 4107.8957 | 4107.8666 | 7.08 | T | 0 | 62 | 6.30E-07 | VKPAHAGSCAGDIMHVPLHPFNYESVNNDDFTR +Deamidated (NQ); K_MMCCH_NL997 (K); Oxidation (M) | 2852 |
| 12 | 2897 | 2919 | 814.6600 | 3254.6108 | 3254.5818 | 8.91 | T | 1 | 39 | 0.00012 | FNYKYDNLNLHGHNIEELEEVLR +K_MMCCH_NL997 (K) | 2900 |
| 13 | 3003 | 3021 | 953.1623 | 2856.4650 | 2856.4467 | 6.44 | T | 1 | 31 | 0.00072 | KYDHTELDASVLPAPIIVR +K_MMCCH_NL673 (K) | 3003 |
| 14 | 613 | 626 | 1151.5167 | 2301.0189 | 2301.0150 | 1.69 | Th | 5 | 13 | 0.05 | ASKKFACCVHGMSV +K_MMCCH_NL673 (K) | 616 |

Figure 14

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1047.4908 | 3139.4507 | 3139.4364 | 4.55 | T | 1 | 27 | 0.002 | KNVDSLSSDEVLALEK +Globo_H_MMCCH (K) | 26 |
| 2 | 164 | 175 | 615.6599 | 1843.9579 | 1843.9516 | 3.42 | T | 1 | 37 | 0.00019 | LFEKVQPGHHTR +K_MMCCH_NL997 (K) | 167 |
| 3 | 249 | 271 | 1012.4535 | 3034.3386 | 3034.3371 | 0.49 | T | 1 | 26 | 0.0024 | GKDPNSADCAHNLIHTPMEPFDR +Deamidated (NQ); K_MMCCH_NL997 (K); Oxidation (M) | 250 |
| 4 | 281 | 293 | 630.2952 | 1887.8639 | 1887.8574 | 3.44 | T | 0 | 44 | 4.00E-05 | EHAKPADSFDYGR +K_MMCCH_NL997 (K) | 284 |
| 5 | 419 | 446 | 942.0073 | 3763.9999 | 3763.9720 | 7.44 | T | 1 | 28 | 0.0015 | QPTLVHRPAKGHFDKPPVPVAQANLAVR +Deamidated (NQ); K_MMCCH_NL673 (K) | 433 |
| 6 | 463 | 488 | 1131.8618 | 3392.5636 | 3392.5918 | -8.28 | T | 2 | 73 | 5.20E-08 | AMERFQNDKSVDGYQATVEFHALPAR +Deamidated (NQ); K_MMCCH_NL997 (K); Oxidation (M) | 471 |
| 7 | 1097 | 1115 | 1008.4838 | 3022.4295 | 3022.4216 | 2.58 | T | 0 | 60 | 1.00E-06 | KPLQPFGLDSVINPDDETR +K_MMCCH_NL511 (K) | 1097 |
| 8 | 1123 | 1149 | 1157.0266 | 4624.0773 | 4624.0513 | 5.62 | T | 1 | 39 | 0.00013 | VFDYKNNFDYEYESLAFNGLSIAQLDR +Globo_H_MMCCH (K) | 1127 |
| 9 | 1355 | 1385 | 1217.5632 | 4866.2238 | 4866.1892 | 7.11 | T | 1 | 18 | 0.016 | GSAVAVPYWDWTEKADSLPSLINDATYFNSR +Globo_H_MMCCH (K) | 1368 |
| 10 | 1455 | 1480 | 853.1725 | 3408.6609 | 3408.6601 | 0.21 | T | 1 | 30 | 0.0009 | AKYSLSSLDYTAFDPVFFLMHANVDR +K_MMCCH (K) | 1456 |
| 11 | 1508 | 1539 | 841.0049 | 4199.9883 | 4199.9680 | 4.83 | T | 1 | 30 | 0.0011 | KPLQPFNNPELNSDSMTLKHNLPQDSFDYQNR +Deamidated (NQ); K_MMCCH_NL997 (K); Oxidation (M) | 1526 |
| 12 | 1949 | 1963 | 574.7631 | 2295.0234 | 2295.0266 | -1.44 | T | 0 | 51 | 8.30E-06 | TQEFSKPEDTFDYHR +K_MMCCH_NL997 (K) | 1954 |
| 13 | 1292 | 1303 | 908.4932 | 1814.9719 | 1814.9713 | 0.39 | G | 0 | 28 | 0.0015 | SIRSAFLQIQKE +K_MMCCH_NL997 (K) | 1302 |
| 14 | 1681 | 1691 | 839.9299 | 1677.8453 | 1677.8508 | -3.28 | G | 0 | 15 | 0.032 | GLSQHNLVRKE +2 Deamidated (NQ); K_MMCCH_NL997 (K) | 1690 |
| 15 | 1589 | 1606 | 1136.1545 | 3405.4418 | 3405.4409 | 0.26 | C | 0 | 23 | 0.005 | ICVEQGGEQNCKTKAGSF +Globo_H_MMCCH (K) | 1602 |
| 16 | 1985 | 1995 | 586.6397 | 1756.8973 | 1756.8930 | 2.45 | C | 0 | 18 | 0.014 | IKQQEADRVF +K_MMCCH_NL997 (K) | 1986 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the amino acid site of K in which identified as Globo_H_MMCCH, K_MMCCH_NL308, K_MMCCH_NL511, K_MMCCH_NL673, K_MMCCH_NL835, or K_MMCCH_NL997 modified for KLH1 or KLH2 sequence.

Figure 15

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 588 | 606 | 1132.8397 | 3395.4973 | 3395.4862 | 3.30 | T | 1 | 25 | 0.0035 | EDKSAGGFQQLGAFHGEPK +Globo_H_MMCCH (K) | 590 |
| 2 | 700 | 719 | 1069.1805 | 3204.5198 | 3204.5060 | 4.31 | T | 1 | 28 | 0.0016 | SVQNKLFEQPEFGHYTSIAK +K_MMCCH_NL511 (K) | 719 |
| 3 | 953 | 965 | 654.6852 | 1961.0337 | 1961.0193 | 7.34 | T | 1 | 42 | 6.00E-05 | DLFKQPSVIHEPR +K_MMCCH_NL997 (K) | 956 |
| 4 | 1092 | 1114 | 645.3080 | 3221.5038 | 3221.5213 | -5.43 | T | 1 | 29 | 0.0013 | QHHYETNPFHHGKITHENEJTTR +K_MMCCH_NL997 (K) | 1104 |
| 5 | 1923 | 1932 | 793.8966 | 1585.7787 | 1585.7745 | 2.65 | T | 1 | 14 | 0.04 | NKVMPNPFAR +Deamidated (NQ); K_MMCCH_NL997 (K); Oxidation (M) | 1924 |
| 6 | 2233 | 2251 | 721.5986 | 2882.3652 | 2882.3776 | -4.30 | T | 2 | 60 | 9.30E-07 | KEINTLTTAEVDNLKDAMR +Deamidated (NQ); K_MMCCH_NL673 (K) | 2247 |
| 7 | 2851 | 2883 | 1027.9795 | 4107.8889 | 4107.8666 | 5.43 | T | 0 | 32 | 0.00058 | VKPAHAGSCAGDIMHVPLHPFNYESVNNDDFTR +Deamidated (NQ); K_MMCCH_NL997 (K); Oxidation (M) | 2852 |
| 8 | 158 | 169 | 733.6753 | 2198.0042 | 2197.9838 | 9.33 | G | 2 | 32 | 0.00064 | AFHKFQEDRSVD +K_MMCCH_NL673 (K) | 161 |
| 9 | 474 | 480 | 568.7975 | 1135.5804 | 1135.5808 | -0.35 | Th | 1 | 16 | 0.024 | VQHKAGT +K_MMCCH_NL997 (K) | 477 |

Figure 15 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1047.4899 | 3139.4478 | 3139.4364 | 3.63 | T | 1 | 29 | 0.0013 | KNVDSLSSDEVLALEK +Globo_H_MMCCH (K) | 26 |
| 2 | 164 | 175 | 615.6570 | 1843.9493 | 1843.9516 | -1.25 | T | 1 | 36 | 0.00026 | LFEKVQPGHHTR +K_MMCCH_NL997 (K) | 167 |
| 3 | 249 | 280 | 1015.9750 | 4059.8708 | 4059.8513 | 4.80 | T | 2 | 26 | 0.0025 | GKDPNSADCAHNLIHTPMEPFDRDTNPLDLTR +Deamidated (NQ); K_MMCCH_NL997 (K); Oxidation (M) | 250 |
| 4 | 281 | 293 | 630.2964 | 1887.8673 | 1887.8574 | 5.30 | T | 0 | 50 | 1.10E-05 | EHAKPADSFDYGR +K_MMCCH_NL997 (K) | 284 |
| 5 | 467 | 488 | 1125.8617 | 3374.5632 | 3374.5500 | 3.91 | T | 1 | 69 | 1.10E-07 | FQNDKSVDGYQATVEFHALPAR +K_MMCCH_NL511 (K) | 471 |
| 6 | 1097 | 1115 | 847.0916 | 2538.2530 | 2538.2312 | 8.59 | T | 0 | 42 | 6.00E-05 | KPLQPFGLDSVINPDDETR +2 Deamidated (NQ); K_MMCCH_NL997 (K) | 1097 |
| 7 | 1123 | 1149 | 1157.0225 | 4624.0607 | 4624.0513 | 2.03 | T | 1 | 35 | 0.00033 | VFDYKNNFDYEYESLAFNGLSIAQLDR +Globo_H_MMCCH | 1127 |
| 8 | 1455 | 1480 | 853.1709 | 3408.6545 | 3408.6601 | -1.64 | T | 1 | 26 | 0.0026 | AKYSLSSLDYTAFDPVEFLHHANVDR +K_MMCCH_NL997 (K) | 1456 |
| 9 | 1508 | 1539 | 840.9999 | 4199.9633 | 4199.9680 | -1.12 | T | 1 | 33 | 0.00054 | KPLQPFNNPELNSDSMTLKHNLPQDSFDYQNR +Deamidated (NQ); K_MMCCH_NL997 (K); Oxidation (M) | 1526 |
| 10 | 1949 | 1963 | 766.0179 | 2295.0318 | 2295.0266 | 2.27 | T | 0 | 29 | 0.0013 | TQEFSKPEDTFDYHR +K_MMCCH_NL997 (K) | 1954 |
| 11 | 1985 | 1995 | 586.6395 | 1756.8968 | 1756.8930 | 2.11 | C | 0 | 19 | 0.014 | IKQQQEADRVF +K_MMCCH_NL997 (K) | 1986 |
| 12 | 2463 | 2479 | 1104.1498 | 3309.4275 | 3309.4269 | 0.18 | C | 1 | 20 | 0.01 | KAQSIHPEDVFDTDAPF +Globo_H_MMCCH (K) | 2463 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the amino acid site of K in which identified as

Figure 15 continued

Globo_H_MMCCH, K_MMCCH_NL308, K_MMCCH_NL511, K_MMCCH_NL673, K_MMCCH_NL835, or K_MMCCH_

Figure 16

| # | Start | End | Observed | Mr(expt) | Mr(calc) | ppm | Enzyme | MC | Score | E value | Peptide | Mod_site |
|---|-------|-----|----------|----------|----------|-----|--------|----|----|---------|---------|----------|
| 1 | 377 | 402 | 852.1614 | 3404.6167 | 3404.6104 | 1.85 | T | 0 | 18 | 0.017 | AHCAISLEHMHLKPFAFSSPLNNNEK +Deamidated (NQ); K_MMCCH_NL997 (K); Oxidation (M) | 402 |
| 2 | 1092 | 1114 | 887.4109 | 3545.6145 | 3545.6270 | -3.53 | T | 1 | 14 | 0.041 | QHHYETNPFHHGKITHENEITTR +K_MMCCH_NL673 (K) | 1104 |
| 3 | 1092 | 1114 | 806.3819 | 3221.4985 | 3221.5213 | -7.08 | T | 1 | 27 | 0.002 | QHHYETNPFHHGKITHENEITTR +K_MMCCH_NL997 (K) | 1104 |
| 4 | 2233 | 2251 | 721.5988 | 2882.3662 | 2882.3776 | -3.96 | T | 2 | 45 | 3.30E-05 | KEINTLTTAEVDNLKDAMR +Deamidated (NQ); K_MMCCH_NL673 (K) | 2247 |
| 5 | 2851 | 2883 | 1027.9769 | 4107.8786 | 4107.8666 | 2.92 | T | 0 | 46 | 2.60E-05 | VKPAHAGSCAGDIMHVPLHPFNYESVNNDDFTR +Deamidated (NQ); K_MMCCH_NL997 (K); Oxidation (M) | 2852 |

Figure 16 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 1097 | 1115 | 847.0920 | 2538.2543 | 2538.2312 | 9.10 | T | 0 | 34 | 0.00043 | KPLQPFGLDSVINPDDETR +2 Deamidated (NQ); K_MMCCH_NL997 (K) | 1097 |
| 2 | 1355 | 1385 | 1217.5588 | 4866.2063 | 4866.1892 | 3.49 | T | 1 | 23 | 0.0047 | GSAVAVPYWDWTEKADSLPSLINDATYFNSR +Globo_H_MMCCH (K) | 1368 |
| 3 | 1508 | 1539 | 841.0057 | 4199.9920 | 4199.9680 | 5.71 | T | 1 | 46 | 2.60E-05 | KPLQPFNMPELINSDSMTLKHNLPQDSFDYQNR +Deamidated (NQ); K_MMCCH_NL997 (K); Oxidation (M) | 1526 |
| 4 | 1949 | 1963 | 766.0202 | 2295.0388 | 2295.0266 | 5.27 | T | 0 | 37 | 0.0002 | TQEFSKPEDTFDYHR +K_MMCCH_NL997 (K) | 1954 |
| 5 | 2463 | 2479 | 1104.1526 | 3309.4359 | 3309.4269 | 2.72 | C | 1 | 17 | 0.019 | KAQSIHPEDVFDTDAPF +Globo_H_MMCCH (K) | 2463 |
| 6 | 2438 | 2447 | 1110.4959 | 2218.9771 | 2218.9749 | 0.99 | Th | 3 | 13 | 0.05 | FILGGSKEMH +K_MMCCH_NL308 (K); Oxidation (M) | 2444 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the amino acid site of K in which identified as Globo_H_MMCCH, K_MMCCH_NL308, K_MMCCH_NL511, K_MMCCH_NL673, K_MMCCH_NL835, or K_MMCCH_NL997 modified for KLH1 or KLH2 sequence.

Figure 17

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 377 | 402 | 1135.8804 | 3404.6193 | 3404.6104 | 2.61 | T | 0 | 41 | 8.80E-05 | AHCAISLEHMHLKPFAFSSPLNNNEK +Deamidated (NQ); K_MMCCH_NL997 (K); Oxidation (M) | 402 |
| 2 | 953 | 965 | 654.6849 | 1961.0330 | 1961.0193 | 6.99 | T | 1 | 27 | 0.0021 | DLFKQPSVIHEPR +K_MMCCH_NL997 (K) | 956 |
| 3 | 1092 | 1114 | 806.3821 | 3221.4995 | 3221.5213 | -6.80 | T | 1 | 18 | 0.015 | QHHYETNPFHHGKITHENEITTR +K_MMCCH_NL997 (K) | 1104 |
| 4 | 1923 | 1932 | 793.8979 | 1585.7812 | 1585.7745 | 4.29 | T | 1 | 17 | 0.021 | NKVMPNPFAR +Deamidated (NQ); K_MMCCH_NL997 (K); Oxidation (M) | 1924 |
| 5 | 2233 | 2251 | 721.5987 | 2882.3657 | 2882.3776 | -4.16 | T | 2 | 41 | 7.90E-05 | KEINTLTTAEVDNLKDAMR +Deamidated (NQ); K_MMCCH_NL673 (K) | 2247 |
| 6 | 2359 | 2367 | 927.4296 | 1852.8447 | 1852.8400 | 2.54 | T | 1 | 21 | 0.0082 | DKLFNDPER +K_MMCCH_NL673 (K) | 2360 |
| 7 | 2851 | 2883 | 1027.9815 | 4107.8967 | 4107.8666 | 7.33 | T | 0 | 30 | 0.00094 | VKPAHAGSCAGDIMHVPLHPFNYESVNNDDFTR +Deamidated (NQ); K_MMCCH_NL997 (K); Oxidation (M) | 2852 |
| 8 | 506 | 512 | 850.4159 | 1698.8173 | 1698.8009 | 9.71 | Th | 2 | 14 | 0.037 | LKDLDLT +K_MMCCH_NL511 (K) | 507 |

Figure 17 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 164 | 175 | 615.6588 | 1843.9544 | 1843.9516 | 1.57 | T | 1 | 42 | 5.90E-05 | LFEKVQPGHHTR +K_MMCCH_NL997 (K) | 167 |
| 2 | 249 | 271 | 1012.4536 | 3034.3388 | 3034.3371 | 0.56 | T | 1 | 19 | 0.013 | GKDPNSADCAHNLIHTPMEPFDR +Deamidated (NQ); K_MMCCH_NL997 (K); Oxidation (M) | 250 |
| 3 | 281 | 293 | 630.2983 | 1887.8732 | 1887.8574 | 8.37 | T | 0 | 41 | 7.80E-05 | EHAKPADSFDYGR +K_MMCCH_NL997 (K) | 284 |
| 4 | 419 | 446 | 941.7554 | 3762.9925 | 3762.9879 | 1.20 | T | 1 | 26 | 0.0027 | QPTLVHRPAKGHFDKPPVPVAQANLAVR +K_MMCCH_NL673 (K) | 433 |
| 5 | 467 | 488 | 1071.8489 | 3212.5248 | 3212.4972 | 8.59 | T | 1 | 75 | 3.40E-08 | FQNDKSVDGYQATVEFHALPAR +K_MMCCH_NL673 (K) | 471 |
| 6 | 1097 | 1115 | 1178.8874 | 3533.6405 | 3533.6118 | 8.15 | T | 0 | 22 | 0.0069 | KPLQPFGLDSVINPDDETR +Globo_H_MMCCH (K) | 1097 |
| 7 | 1949 | 1963 | 766.0211 | 2295.0415 | 2295.0266 | 6.49 | T | 0 | 44 | 4.40E-05 | TQEFSKPEDTFDYHR +K_MMCCH_NL997 (K) | 1954 |
| 8 | 1985 | 1995 | 586.6405 | 1756.8997 | 1756.8930 | 3.81 | C | 0 | 22 | 0.0061 | IKQQQEADRVF +K_MMCCH_NL997 (K) | 1986 |
| 9 | 2463 | 2479 | 1104.1505 | 3309.4297 | 3309.4269 | 0.85 | C | 1 | 16 | 0.028 | KAQSIHPEDVFDTDAPF +Globo_H_MMCCH (K) | 2463 |
| 10 | 1525 | 1539 | 865.7426 | 2594.2060 | 2594.1959 | 3.89 | Th | 3 | 20 | 0.015 | LKHNLPQDSFDYQNR +K_MMCCH_NL673 (K) | 1526 |
| 11 | 1952 | 1963 | 646.6356 | 1936.8850 | 1936.8778 | 3.77 | Th | 2 | 55 | 3.00E-06 | FSKPEDTFDYHR +K_MMCCH_NL997 (K) | 1954 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the amino acid site of K in which identified as Globo_H_MMCCH, K_MMCCH, K_MMCCH_NL308, K_MMCCH_NL511, K_MMCCH_NL673, K_MMCCH_NL835, or K_MMCCH_NL997 modified for KLH1 or KLH2 sequence.

Figure 18

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 588 | 606 | 1132.8378 | 3395.4915 | 3395.4862 | 1.56 | T | 1 | 19 | 0.012 | EDKSAGGFQQLGAFHGEPK +Globo_H_MMCCH (K) | 590 |
| 2 | 700 | 719 | 1015.1627 | 3042.4663 | 3042.4532 | 4.31 | T | 1 | 30 | 0.00093 | SVQNKLFEQPEFGHYTSIAK +K_MMCCH_NL673 (K) | 719 |
| 3 | 953 | 965 | 762.7192 | 2285.1359 | 2285.1249 | 4.81 | T | 1 | 47 | 2.10E-05 | DLFKQPSVIHEPR +K_MMCCH_NL673 (K) | 956 |
| 4 | 1092 | 1114 | 1074.8417 | 3221.5032 | 3221.5213 | -5.62 | T | 1 | 30 | 0.001 | QHHYETNPFHHGKITHENEITTR +K_MMCCH_NL997 (K) | 1104 |
| 5 | 1417 | 1445 | 980.2136 | 3916.8254 | 3916.8135 | 3.04 | T | 1 | 14 | 0.041 | ADHSSDGFQAIASFHALPPLCPSPAASKR +K_MMCCH_NL511 (K) | 1444 |
| 6 | 1473 | 1489 | 905.7894 | 2714.3463 | 2714.3414 | 1.81 | T | 1 | 17 | 0.022 | KHGAVVGLPYWDWTLPR +K_MMCCH_NL673 (K) | 1473 |
| 7 | 1923 | 1932 | 793.8984 | 1585.7822 | 1585.7745 | 4.86 | T | 1 | 15 | 0.034 | NKVMPNPFAR +Deamidated (NQ); K_MMCCH_NL997 (K); Oxidation (M) | 1924 |
| 8 | 2233 | 2251 | 721.5977 | 2882.3618 | 2882.3776 | -5.48 | T | 2 | 23 | 0.0048 | KEINTLTTAEVDNLKDAMR +Deamidated (NQ); K_MMCCH_NL997 (K) | 2247 |
| 9 | 2359 | 2367 | 1008.4539 | 2014.8933 | 2014.8929 | 0.20 | T | 1 | 17 | 0.022 | DKLFNDPER +K_MMCCH_NL511 (K) | 2360 |
| 10 | 2851 | 2883 | 1027.9791 | 4107.8874 | 4107.8666 | 5.06 | T | 0 | 35 | 0.0003 | VKPAHAGSCAGDIMHVPLHPFNVESVNNDDFTR +Deamidated (NQ); K_MMCCH_NL997 (K); Oxidation (M) | 2852 |
| 11 | 2897 | 2919 | 814.6596 | 3254.6093 | 3254.5818 | 8.45 | T | 1 | 36 | 0.00024 | FNYKYDNLNLHGHNIEELEEVLR +K_MMCCH_NL997 (K) | 2900 |
| 12 | 3003 | 3021 | 953.1583 | 2856.4530 | 2856.4467 | 2.21 | T | 1 | 17 | 0.021 | KYDHTELDASVLPAPHVR +K_MMCCH_NL673 (K) | 3003 |
| 13 | 158 | 169 | 733.6757 | 2198.0053 | 2197.9838 | 9.83 | G | 2 | 14 | 0.044 | AFHKFQEDRSVD +K_MMCCH_NL673 (K) | 161 |

Figure 18 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1047.4894 | 3139.4463 | 3139.4364 | 3.15 | T | 1 | 17 | 0.021 | KNVDSLSSDEVLALEK +Globo_H_MMCCH (K) | 26 |
| 2 | 164 | 175 | 615.6602 | 1843.9587 | 1843.9516 | 3.85 | T | 1 | 38 | 0.00015 | LFEKVQPGHHTR +K_MMCCH_NL997 (K) | 167 |
| 3 | 281 | 293 | 630.2961 | 1887.8664 | 1887.8574 | 4.82 | T | 0 | 47 | 2.10E-05 | EHAKPADSFDYGR +K_MMCCH_NL997 (K) | 284 |
| 4 | 419 | 446 | 860.9789 | 3439.8867 | 3439.8663 | 5.93 | T | 1 | 25 | 0.0029 | QPTLVHRPAKGHFDKPPVPVAQANLAVR +Deamidated (NQ); K_MMCCH_NL997 (K) | 433 |
| 5 | 467 | 488 | 1125.8600 | 3374.5581 | 3374.5500 | 2.40 | T | 1 | 68 | 1.40E-07 | FQNDKSVDGYQATVEFHALPAR +K_MMCCH_NL511 (K) | 471 |
| 6 | 936 | 950 | 847.7374 | 2540.1903 | 2540.1682 | 8.70 | T | 1 | 15 | 0.029 | KHGFTGGLPYWDWTR +K_MMCCH_NL673 (K) | 936 |
| 7 | 1097 | 1115 | 1008.4823 | 3022.4251 | 3022.4216 | 1.12 | T | 0 | 54 | 3.80E-06 | KPLQPFGLDSVINPDDETR +K_MMCCH_NL511 (K) | 1097 |
| 8 | 1455 | 1480 | 853.1713 | 3408.6562 | 3408.6601 | -1.14 | T | 1 | 27 | 0.0022 | AKYSLSLDYTAFDPVFLHHANVDR +K_MMCCH_NL997 (K) | 1456 |
| 9 | 1508 | 1539 | 841.0015 | 4199.9709 | 4199.9680 | 0.69 | T | 1 | 37 | 0.00018 | KPLQPFNNPELNSDSMTLKHNLPQDSFDYQNR +Deamidated (NQ); K_MMCCH_NL997 (K); Oxidation (M) | 1526 |
| 10 | 1949 | 1963 | 574.7651 | 2295.0315 | 2295.0266 | 2.09 | T | 0 | 55 | 3.30E-06 | TQEFSKPEDTFDYHR +K_MMCCH_NL997 (K) | 1954 |
| 11 | 2527 | 2541 | 691.3613 | 2071.0620 | 2071.0619 | 0.05 | T | 1 | 15 | 0.03 | KDVTSLTASEIENLR +K_MMCCH_NL997 (K) | 2527 |
| 12 | 3008 | 3025 | 845.4286 | 2533.2641 | 2533.2576 | 2.57 | T | 1 | 14 | 0.043 | ALKEHGSHLGIPYWDWTK +K_MMCCH_NL997 (K) | 3025 |
| 13 | 1292 | 1303 | 605.9988 | 1814.9745 | 1814.9713 | 1.82 | G | 0 | 16 | 0.023 | SIRSAFLQIQKE +K_MMCCH_NL997 (K) | 1302 |
| 14 | 2463 | 2479 | 1104.1495 | 3309.4268 | 3309.4269 | -0.03 | C | 1 | 19 | 0.012 | KAQSIHPEDVFDTDAPF +Globo_H_MMCCH (K) | 2463 |
| 15 | 1554 | 1560 | 621.8187 | 1241.6229 | 1241.6326 | -7.73 | Th | 1 | 14 | 0.036 | IQKLDQT +Deamidated (NQ); K_MMCCH_NL997 (K) | 1556 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW

Figure 18 continued respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the amino acid site of K in which identified as Globo_H_MMCCH, K_MMCCH_NL308, K_MMCCH_NL511, K_MMCCH_NL673, K_MMCCH_NL835, or K_MMCCH_NL997 modified for KLH1 or KLH2 sequence.

Figure 19

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 953 | 965 | 654.6824 | 1961.0253 | 1961.0193 | 3.06 | T | 1 | 46 | 2.60E-05 | DLFKQPSVIHEPR +K_MMCCH_NL997 (K) | 956 |
| 2 | 1092 | 1114 | 806.3803 | 3221.4919 | 3221.5213 | -9.13 | T | 1 | 18 | 0.015 | QHHYETNPFHHGKITHENEITTR +K_MMCCH_NL997 (K) | 1104 |
| 3 | 1417 | 1445 | 1108.0071 | 4427.9992 | 4428.0036 | -0.99 | T | 1 | 13 | 0.046 | ADHSSDGFQAIASFHALPPLCPSPAASKR +Globo_H_MMCCH (K) | 1444 |
| 4 | 2233 | 2251 | 721.5986 | 2882.3654 | 2882.3776 | -4.23 | T | 2 | 37 | 0.0002 | KEINTLTTAEVDNLKDAMR +Deamidated (NQ); K_MMCCH_NL673 (K) | 2247 |
| 5 | 2359 | 2367 | 927.4279 | 1852.8413 | 1852.8400 | 0.65 | T | 1 | 17 | 0.02 | DKLFNDPER +K_MMCCH_NL673 (K) | 2360 |
| 6 | 2851 | 2883 | 1027.9758 | 4107.8742 | 4107.8666 | 1.85 | T | 0 | 37 | 0.00018 | VKPAHAGSCAGDIMHVPLHPFNYESVNNDDFTR +Deamidated (NQ); K_MMCCH_NL997 (K); Oxidation (M) | 2852 |
| 7 | 1649 | 1664 | 1104.1271 | 3309.3594 | 3309.3654 | -1.81 | C | 2 | 14 | 0.038 | NLNDHTHDFSKPEDTF +Globo_H_MMCCH (K) | 1659 |

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1047.4901 | 3139.4485 | 3139.4364 | 3.85 | T | 1 | 21 | 0.0089 | KNVDSLSSDEVLALEK +Globo_H_MMCCH (K) | 26 |
| 2 | 164 | 175 | 615.6576 | 1843.9509 | 1843.9516 | -0.33 | T | 1 | 33 | 0.00046 | LFEKVQPGHHTR +K_MMCCH_NL997 (K) | 167 |
| 3 | 249 | 271 | 1012.4529 | 3034.3368 | 3034.3371 | -0.10 | T | 1 | 16 | 0.025 | GKDPNSADCAHNLiHTPMEPFDR +Deamidated (NQ); K_MMCCH_NL997 (K); Oxidation (M) | 250 |
| 4 | 281 | 293 | 630.2961 | 1887.8666 | 1887.8574 | 4.87 | T | 0 | 49 | 1.10E-05 | EHAKPADSFDYGR +K_MMCCH_NL997 (K) | 284 |
| 5 | 419 | 446 | 942.0069 | 3763.9985 | 3763.9720 | 7.04 | T | 1 | 30 | 0.0011 | QPTLVHRPAKGHFDKPPVPVAQANLAVR +Deamidated (NQ); K_MMCCH_NL673 (K) | 433 |
| 6 | 467 | 488 | 1125.8563 | 3374.5471 | 3374.5500 | -0.86 | T | 1 | 59 | 1.20E-06 | FQNDKSVDGYQATVEFHALPAR +K_MMCCH_NL511 (K) | 471 |
| 7 | 1097 | 1115 | 847.0906 | 2538.2501 | 2538.2312 | 7.45 | T | 0 | 26 | 0.0024 | KPLQPFGLDSVINPDDETR +2 Deamidated (NQ); K_MMCCH_NL997 (K) | 1097 |
| 8 | 1355 | 1385 | 1217.5574 | 4866.2004 | 4866.1892 | 2.28 | T | 1 | 15 | 0.029 | GSAVAVPYWDWTEKADSLPSLINDATYFNSR +Globo_H_MMCCH (K) | 1368 |
| 9 | 1508 | 1526 | 862.7620 | 2585.2642 | 2585.2505 | 5.30 | T | 0 | 15 | 0.03 | KPLQPFNNPELNSDSMTLK +Deamidated (NQ); K_MMCCH_NL997 (K); Oxidation (M) | 1526 |
| 10 | 1949 | 1963 | 928.0676 | 2781.1811 | 2781.1851 | -1.44 | T | 0 | 49 | 1.20E-05 | TQEFSKPEDTFDYHR +K_MMCCH_NL511 (K) | 1954 |
| 11 | 2527 | 2541 | 691.3618 | 2071.0635 | 2071.0619 | 0.72 | T | 1 | 21 | 0.0083 | KDVTSLTASEIENLR +K_MMCCH_NL997 (K) | 2527 |
| 12 | 1292 | 1303 | 605.9978 | 1814.9716 | 1814.9713 | 0.17 | G | 0 | 16 | 0.026 | SIRSAFLQICKE +K_MMCCH_NL997 (K) | 1302 |
| 13 | 1526 | 1540 | 1101.4783 | 3301.4130 | 3301.4232 | -3.09 | C | 2 | 17 | 0.021 | KHNLPQDSFDYQNRF +Globo_H_MMCCH (K) | 1526 |
| 14 | 1985 | 1995 | 586.6373 | 1756.8902 | 1756.8930 | -1.65 | C | 0 | 23 | 0.0049 | IKQQQEADRYF +K_MMCCH_NL997 (K) | 1986 |
| 15 | 2463 | 2479 | 1104.1492 | 3309.4257 | 3309.4269 | -0.36 | C | 1 | 23 | 0.0045 | KAQSIHPEDVFDTDAPF +Globo_H_MMCCH (K) | 2463 |

"Start" and "End" indicates the number of residue of KLH1 or KLH2. "Observed" column implies the observed m/z value in the survey scan while "Mr(expt)",

"Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the amino acid site of K in which identified as Globo_H_MMCCH, K_MMCCH_NL308, K_MMCCH_NL511, K_MMCCH_NL673, K_MMCCH_NL835, or K_MMCCH_NL997 modified for KLH1 or KLH2 sequence.

Figure 20

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 377 | 402 | 852.1617 | 3404.6179 | 3404.6104 | 2.20 | T | 0 | 14 | 0.037 | AHCAISLEHMHLKPFAFSSPLNNNEK +Deamidated (NQ); K_MMCCH_NL997 (K); Oxidation (M) | 402 |
| 2 | 700 | 719 | 1069.1809 | 3204.5209 | 3204.5060 | 4.65 | T | 1 | 19 | 0.012 | SVQNKLFEQPEFGHYTSIAK +K_MMCCH_NL511 (K) | 719 |
| 3 | 1092 | 1114 | 806.3823 | 3221.4999 | 3221.5213 | -6.64 | T | 1 | 17 | 0.019 | QHHYETNPFHHGKITHENEIITR +K_MMCCH_NL997 (K) | 1104 |
| 4 | 2233 | 2251 | 721.5977 | 2882.3618 | 2882.3776 | -5.48 | T | 2 | 28 | 0.0016 | KEINTLTTAEVDNLKDAMR +Deamidated (NQ); K_MMCCH_NL673 (K) | 2247 |
| 5 | 2851 | 2883 | 1027.9711 | 4107.8552 | 4107.8666 | -2.78 | T | 0 | 32 | 0.00067 | VKPAHAGSCAGDIMHVPLHPFNYESVNNDDFTR +Deamidated (NQ); K_MMCCH_NL997 (K); Oxidation (M) | 2852 |
| 6 | 158 | 169 | 733.6741 | 2198.0006 | 2197.9838 | 7.64 | G | 2 | 16 | 0.025 | AFHKFQEDRSVD +K_MMCCH_NL673 (K) | 161 |

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 419 | 446 | 941.7502 | 3762.9719 | 3762.9879 | -4.28 | T | 1 | 16 | 0.028 | QPTLVHRPAKGHFDKPPVAQANLAVR +K_MMCCH_NL673 (K) | 433 |
| 2 | 1097 | 1115 | 847.0919 | 2538.2539 | 2538.2312 | 8.94 | T | 0 | 44 | 3.60E-05 | KPLQPFGLDSVINPDDETR +2 Deamidated (NQ); K_MMCCH_NL997 (K) | 1097 |
| 3 | 1355 | 1385 | 1217.5449 | 4866.1506 | 4866.1892 | -7.95 | T | 1 | 23 | 0.0053 | GSAVAVPYWDWTEKADSLPSLINDATYFNSR +Globo_H_MMCCH (K) | 1368 |
| 4 | 1508 | 1539 | 841.0017 | 4199.9722 | 4199.9680 | 0.98 | T | 1 | 55 | 3.50E-06 | KPLQPFNINPELINSDSMTLKHNLPQDSFDYQNR +Deamidated (NQ); K_MMCCH_NL997 (K); Oxidation (M) | 1526 |
| 5 | 1224 | 1235 | 939.9670 | 1877.9195 | 1877.9022 | 9.21 | Th | 5 | 14 | 0.041 | LHVGDNFFLKYE +Deamidated (NQ); K_MMCCH_NL997 (K) | 1233 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the amino acid site of K in which identified as Globo_H_MMCCH, K_MMCCH_NL308, K_MMCCH_NL511, K_MMCCH_NL673, K_MMCCH_NL835, or K_MMCCH_NL997 modified for KLH1 or KLH2 sequence.

Figure 20 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 778 | 789 | 986.5373 | 1971.0600 | 1971.0553 | 2.44 | T | 1 | 17 | 0.021 | IWAIWQALQKYR +K_MMCCH_NL997 (K) | 787 |
| 2 | 953 | 965 | 654.6835 | 1961.0288 | 1961.0193 | 4.84 | T | 1 | 32 | 0.00065 | DLFKQPSVIHEPR +K_MMCCH_NL997 (K) | 956 |
| 3 | 1092 | 1114 | 806.3824 | 3221.5007 | 3221.5213 | -6.39 | T | 1 | 24 | 0.004 | QHHYETNPFHHGKITHENEITTR +K_MMCCH_NL997 (K) | 1104 |
| 4 | 1923 | 1932 | 793.8977 | 1585.7809 | 1585.7745 | 4.04 | T | 1 | 19 | 0.011 | NKVMPNPFAR +Deamidated (NQ); K_MMCCH_NL997 (K); Oxidation (M) | 1924 |
| 5 | 2233 | 2251 | 721.5991 | 2882.3671 | 2882.3776 | -3.64 | T | 2 | 17 | 0.022 | KEINTLTTAEVDNLKDAMR +Deamidated (NQ); K_MMCCH_NL673 (K) | 2247 |
| 6 | 2851 | 2883 | 1027.9812 | 4107.8957 | 4107.8666 | 7.08 | T | 0 | 49 | 1.20E-05 | VKPAHAGSCAGDIMHVPLHPFNYESVNNDDFTR +Deamidated (NQ); K_MMCCH_NL997 (K); Oxidation (M) | 2852 |
| 7 | 1649 | 1664 | 1104.1299 | 3309.3678 | 3309.3654 | 0.73 | C | 2 | 14 | 0.042 | NLNDHTHDFSKPEDTF +Globo_H_MMCCH (K) | 1659 |
| 8 | 601 | 612 | 955.3971 | 2863.1694 | 2863.1715 | -0.73 | Th | 1 | 26 | 0.0026 | FHGEPKWCPSPE +Globo_H_MMCCH (K) | 606 |
| 9 | 1580 | 1587 | 763.8522 | 1525.6899 | 1525.6858 | 2.69 | Th | 1 | 14 | 0.037 | VGGKEPYG +K_MMCCH_NL673 (K) | 1583 |

Figure 21

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 164 | 175 | 615.6603 | 1843.9592 | 1843.9516 | 4.12 | T | 1 | 40 | 0.00011 | LFEKVQPGHHTR +K_MMCCH_NL997 (K) | 167 |
| 2 | 281 | 293 | 630.2977 | 1887.8714 | 1887.8574 | 7.42 | T | 0 | 40 | 9.20E-05 | EHAKPADSFDYGR +K_MMCCH_NL997 (K) | 284 |
| 3 | 467 | 488 | 1071.8480 | 3212.5222 | 3212.4972 | 7.78 | T | 1 | 60 | 1.00E-06 | FQNDKSVDGYQATVEFHALPAR +K_MMCCH_NL673 (K) | 471 |
| 4 | 1097 | 1115 | 1178.8835 | 3533.6288 | 3533.6118 | 4.81 | T | 0 | 19 | 0.014 | KPLQPFGLDSVINPDDETR +Globo_H_MMCCH (K) | 1097 |
| 5 | 1949 | 1963 | 766.0208 | 2295.0406 | 2295.0266 | 6.10 | T | 0 | 34 | 0.00039 | TQEFSKPEDTFDYHR +K_MMCCH_NL997 (K) | 1954 |
| 6 | 2728 | 2739 | 986.5373 | 1971.0600 | 1971.0553 | 2.44 | T | 1 | 17 | 0.021 | IWAIWQALQKYR +K_MMCCH_NL997 (K) | 2737 |
| 7 | 1985 | 1995 | 586.6405 | 1756.8997 | 1756.8930 | 3.81 | C | 0 | 23 | 0.0046 | IKQQQEADRVF +K_MMCCH_NL997 (K) | 1986 |
| 8 | 2463 | 2479 | 1104.1527 | 3309.4363 | 3309.4269 | 2.84 | C | 1 | 14 | 0.037 | KAQSIHPEDVFDTDAPF +Globo_H_MMCCH (K) | 2463 |
| 9 | 893 | 904 | 955.3971 | 2863.1694 | 2863.1715 | -0.73 | Th | 1 | 26 | 0.0026 | FHGEPKWCPSPE +Globo_H_MMCCH (K) | 898 |
| 10 | 1224 | 1233 | 1036.4961 | 2070.9776 | 2070.9707 | 3.33 | Th | 4 | 15 | 0.029 | LHVGDNFFLK +K_MMCCH_NL511 (K) | 1233 |
| 11 | 1952 | 1963 | 646.6351 | 1936.8834 | 1936.8778 | 2.89 | Th | 2 | 24 | 0.0041 | FSKPEDTFDYHR +K_MMCCH_NL997 (K) | 1954 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the amino acid site of K in which identified as Globo_H_MMCCH, K_MMCCH_NL308, K_MMCCH_NL511, K_MMCCH_NL673, K_MMCCH_NL835, or K_MMCCH_NL997 modified for KLH1 or KLH2 sequence.

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 124 | 141 | 785.4098 | 2353.2075 | 2353.2001 | 3.14 | T | 1 | 21 | 0.0086 | GFTDPPVKHHQSANLLVR +dK_MMCCH-2 (K) | 131 |
| 2 | 157 | 166 | 823.3666 | 1644.7187 | 1644.7242 | -3.34 | T | 1 | 20 | 0.011 | EAPHKFQEDR +Deamidated (NQ); dK_MMCCH-2 (K) | 161 |
| 3 | 377 | 402 | 833.3975 | 3329.5607 | 3329.5784 | -5.29 | T | 0 | 37 | 0.00019 | AHCAISLEHMHLKPFAFSSPLNNNEK +dK_MMCCH-2 (K) | 389 |
| 4 | 460 | 477 | 781.3958 | 2341.1654 | 2341.1624 | 1.28 | T | 1 | 19 | 0.014 | TSANVDIFIKTTDSVQHK +dK_MMCCH-2 (K) | 469 |
| 5 | 470 | 488 | 748.0436 | 2241.1091 | 2241.1100 | -0.40 | T | 1 | 18 | 0.017 | TTDSVQHKAGTFAVLGGSK +dK_MMCCH-2 (K) | 477 |
| 6 | 489 | 496 | 718.8198 | 1435.6251 | 1435.6377 | -8.78 | T | 1 | 15 | 0.029 | EMKWGFDR +dK_MMCCH-1 (K); Oxidation (M) | 491 |
| 7 | 553 | 560 | 663.8676 | 1325.7207 | 1325.7166 | 3.09 | T | 2 | 23 | 0.0051 | VKFDKVPR +dK_MMCCH-2 (K) | 554 |
| 8 | 566 | 570 | 485.2450 | 968.4754 | 968.4749 | 0.52 | T | 1 | 16 | 0.028 | KNVDR +dK_MMCCH-2 (K) | 566 |
| 9 | 581 | 587 | 547.8376 | 1093.6606 | 1093.6569 | 3.38 | T | 1 | 19 | 0.013 | KALALLK +dK_MMCCH-2 (K) | 581 |
| 10 | 588 | 606 | 781.0359 | 2340.0858 | 2340.0845 | 0.60 | T | 1 | 31 | 0.00076 | EDKSAGGFQQLGAFHGEPK +dK_MMCCH-2 (K) | 590 |
| 11 | 591 | 615 | 1004.4674 | 3010.3804 | 3010.3742 | 2.06 | T | 1 | 16 | 0.024 | SAGGFQQLGAFHGEPKWCPSPEASK +dK_MMCCH-2 (K) | 606 |
| 12 | 645 | 681 | 1158.5342 | 4630.1076 | 4630.1063 | 0.28 | T | 1 | 26 | 0.0025 | HGYDGALPYWDWTSPLNHLPELADHEKYVDPEDGVEK +dK_MMCCH-2 (K) | 671 |
| 13 | 682 | 699 | 1239.5814 | 2477.1483 | 2477.1434 | 1.98 | T | 1 | 18 | 0.016 | HNPWFDGHDTVDKTTTR +dK_MMCCH-2 (K) | 695 |
| 14 | 700 | 719 | 887.7735 | 2660.2987 | 2660.2945 | 1.58 | T | 1 | 44 | 4.20E-05 | SVQNKLFEQPEFGHYTSIAK +dK_MMCCH-2 (K) | 704 |
| 15 | 778 | 789 | 957.9996 | 1913.9846 | 1913.9862 | -0.84 | T | 1 | 32 | 0.00059 | IWAIWQALQKYR +Deamidated (NQ); dK_MMCCH-2 (K) | 787 |
| 16 | 790 | 804 | 669.3175 | 2004.9307 | 2004.9220 | 4.34 | T | 0 | 49 | 1.20E-05 | GKPYNVANCAVTSMR +dK_MMCCH-2 (K) | 791 |
| 17 | 858 | 863 | 520.3004 | 1038.5863 | 1038.5783 | 7.70 | T | 1 | 19 | 0.013 | KLEAIK +dK_MMCCH-2 (K) | 858 |
| 18 | 953 | 965 | 635.3312 | 1902.9717 | 1902.9662 | 2.89 | T | 1 | 47 | 1.90E-05 | DLFKQPSVIHEPR +dK_MMCCH-2 (K) | 956 |

| 19 | 986 | 1000 | 1027.0348 | 2052.0550 | 2052.0561 | -0.54 | T | 1 | 84 | 4.40E-09 | KNIENLSLGELESLR +dK_MMCCH-2 (K) | 986 |
| 20 | 1048 | 1060 | 913.5302 | 1825.0459 | 1825.0423 | 1.97 | T | 1 | 26 | 0.0024 | LYVVVENALLKK +dK_MMCCH-2 (K) | 1060 |
| 21 | 1092 | 1114 | 633.9023 | 3164.4753 | 3164.4523 | 7.30 | T | 1 | 33 | 0.00052 | QHHYETNPFHHGKITHENEJTTR +Deamidated (NQ); dK_MMCCH-2 (K) | 1104 |
| 22 | 1118 | 1162 | 1131.7467 | 5653.6971 | 5653.6850 | 2.14 | T | 1 | 18 | 0.014 | DSLFHSDYFYEQVLYALEQDNFCDFEIQLEILHNALHSLLGGKGK +dK_MMCCH-2 (K) | 1162 |
| 23 | 1199 | 1203 | 353.1915 | 1056.5526 | 1056.5538 | 1.23 | T | 1 | 17 | 0.019 | KRPYR +dK_MMCCH 2 (K) | 1199 |
| 24 | 1331 | 1338 | 620.3547 | 1238.6949 | 1238.6944 | 0.40 | T | 1 | 23 | 0.0054 | LDITKALK +dK_MMCCH-2 (K) | 1335 |
| 25 | 1395 | 1403 | 485.5956 | 1453.7651 | 1453.7599 | 3.58 | T | 2 | 25 | 0.0031 | KDITQLDKR +dK_MMCCH-2 (K) | 1395 |
| 26 | 1395 | 1403 | 598.3075 | 1791.9007 | 1791.8899 | 5.97 | T | 2 | 21 | 0.0084 | KDITQLDKR +2 dK_MMCCH-2 (K) | 1395, 1402 |
| 27 | 1417 | 1445 | 1125.2136 | 3372.6190 | 3372.6020 | 5.07 | T | 1 | 27 | 0.002 | ADHSSDGFQAIASFHALPLCPSPAASKR +dK_MMCCH-2 (K) | 1444 |
| 28 | 1473 | 1489 | 778.4057 | 2332.1953 | 2332.1827 | 5.40 | T | 1 | 46 | 2.60E-05 | KHGAVVGLPYWDWTLPR +dK_MMCCH-2 (K) | 1473 |
| 29 | 1519 | 1530 | 898.9364 | 1795.8582 | 1795.8563 | 1.06 | T | 1 | 16 | 0.025 | IEFEGENVHTKR +dK_MMCCH-2 (K) | 1529 |
| 30 | 1721 | 1746 | 1092.8095 | 3275.4065 | 3275.3886 | 5.47 | T | 1 | 15 | 0.035 | TAGDCEDAGYFTVLGGEKEMPWAFDR +dK_MMCCH-2 (K); Oxidation (M) | 1738 |
| 31 | 1747 | 1758 | 613.9775 | 1838.9108 | 1838.9012 | 5.22 | T | 1 | 22 | 0.0067 | LYKYDITETLDK +dK_MMCCH-2 (K) | 1749 |
| 32 | 1923 | 1932 | 756.3798 | 1510.7451 | 1510.7425 | 1.72 | T | 1 | 29 | 0.0012 | NKVMPNPFAR +dK_MMCCH-2 (K) | 1924 |
| 33 | 2067 | 2076 | 746.8879 | 1491.7613 | 1491.7544 | 4.63 | T | 1 | 27 | 0.0021 | KHAVPNDVFK +dK_MMCCH-2 (K) | 2067 |
| 34 | 2068 | 2083 | 753.7155 | 2258.1247 | 2258.1194 | 2.35 | T | 1 | 16 | 0.025 | HAVPNDVFKYELLGYR +dK_MMCCH-2 (K) | 2076 |
| 35 | 2121 | 2149 | 890.4191 | 3557.6472 | 3557.6378 | 2.64 | T | 1 | 37 | 0.00021 | TSADVQFQICKTSEDCHHGGQIFVLGGTK +dK_MMCCH-2 (K) | 2131 |
| 36 | 2299 | 2314 | 715.0181 | 2142.0324 | 2142.0238 | 4.01 | T | 1 | 60 | 9.80E-07 | LYTKQMEDALTAHGAR +dK_MMCCH-2 (K) | 2302 |
| 37 | 2359 | 2367 | 736.3492 | 1470.6839 | 1470.6813 | 1.77 | T | 1 | 35 | 0.00034 | DKLFNDPER +dK_MMCCH-2 (K) | 2360 |
| 38 | 2461 | 2490 | 642.8196 | 3850.8742 | 3850.8638 | 2.70 | T | 0 | 16 | 0.026 | RPLRPFSDPINHNAFTHSNAKPTDVFEYSR +dK_MMCCH-2 (K) | 2481 |
| 39 | 2507 | 2514 | 682.3518 | 1362.6889 | 1362.6853 | 2.64 | T | 1 | 30 | 0.001 | KLEHELEK +dK_MMCCH-2 (K) | 2507 |
| 40 | 2515 | 2520 | 571.7622 | 1141.5099 | 1141.5074 | 2.19 | T | 1 | 19 | 0.012 | QKEEDR +dK_MMCCH-2 (K) | 2516 |

Figure 22 continued

| | | | | | | | | | | |
|---|---|---|---|---|---|---|---|---|---|---|
| 41 | 2595 | 2609 | 983.5271 | 1965.0396 | 1965.0493 | -4.89 | T | 1 | 17 | 0.02 | IIDTSGKQLPSDLIK +dK_MMCCH-2 (K) | 2601 |
| 42 | 2621 | 2636 | 802.7155 | 2405.1245 | 2405.1083 | 6.74 | T | 1 | 51 | 8.60E-06 | HHEKHHEDHHEDILVR +dK_MMCCH-2 (K) | 2624 |
| 43 | 2637 | 2651 | 1069.5284 | 2137.0423 | 2137.0374 | 2.29 | T | 1 | 59 | 1.40E-06 | KNIHSLSHHEAEELR +dK_MMCCH-2 (K) | 2637 |
| 44 | 2652 | 2682 | 975.2011 | 3896.7753 | 3896.7563 | 4.90 | T | 1 | 14 | 0.041 | DALYKLQNDESHGGYEHIAGFHGYPNLCPEK +dK_MMCCH-2 (K) | 2656 |
| 45 | 2761 | 2814 | 1328.4260 | 6637.0938 | 6637.0821 | 1.76 | T | 1 | 20 | 0.0094 | DVNEAIFQQTKFGEFSSIFYLALQALEEDNYCDFEVQYEILHNEVHALIGGAEK +4 Deamidated (NQ); dK_MMCCH 1 (K) | 2771 |
| 46 | 2851 | 2883 | 1009.2216 | 4032.8574 | 4032.8346 | 5.65 | T | 0 | 69 | 1.20E-07 | VKPAHAGSCAGDIMHVPLHPFNYESVNNDDFTR +dK_MMCCH-2 (K) | 2852 |
| 47 | 2897 | 2919 | 1066.5184 | 3196.5335 | 3196.5287 | 1.47 | T | 1 | 55 | 3.20E-06 | FNYKYDNLNLHGHNIEELEEVLR +dK_MMCCH-2 (K) | 2900 |
| 48 | 2938 | 2947 | 730.4154 | 1458.8163 | 1458.8156 | 0.48 | T | 1 | 20 | 0.01 | TTAVVKVYIK +dK_MMCCH-2 (K) | 2943 |
| 49 | 3003 | 3021 | 825.7748 | 2474.3027 | 2474.2879 | 5.98 | T | 1 | 46 | 2.80E-05 | KYDHTELDASVLPAPIIVR +dK_MMCCH-2 (K) | 3003 |
| 50 | 3022 | 3044 | 966.5284 | 2896.5635 | 2896.5521 | 3.94 | T | 1 | 15 | 0.03 | RPNNAVFDIIEIPIGKDVNLPPK +dK_MMCCH-2 (K) | 3037 |
| 51 | 123 | 151 | 739.7915 | 3693.9211 | 3693.9049 | 4.39 | T | 2 | 31 | 0.00075 | KGFTDPPVKHHQSANLLVRKNINDLTREE +dK_MMCCH-2 (K) | 131 |
| 52 | 158 | 176 | 846.3878 | 2536.1415 | 2536.1329 | 3.39 | G | 3 | 25 | 0.0034 | AFHKFQEDRSVDGYQATAE +dK_MMCCH-2 (K) | 161 |
| 53 | 435 | 442 | 676.3259 | 1350.6373 | 1350.6312 | 4.52 | G | 1 | 15 | 0.03 | NIEKMIHE +dK_MMCCH-2 (K) | 438 |
| 54 | 526 | 544 | 777.7507 | 2330.2304 | 2330.2304 | 0.00 | G | 1 | 34 | 0.00038 | VDGTKLASSLIPHASVIRE +dK_MMCCH-2 (K) | 530 |
| 55 | 589 | 612 | 1102.8276 | 3305.4611 | 3305.4621 | -0.30 | G | 1 | 13 | 0.048 | DKSAGGFQQLGAFHGEPKWCPSPE +2 dK_MMCCH-2 (K) | 590, 606 |
| 56 | 589 | 612 | 990.1173 | 2967.3301 | 2967.3320 | -0.64 | G | 1 | 22 | 0.0057 | DKSAGGFQQLGAFHGEPKWCPSPE +dK_MMCCH-2 (K) | 606 |
| 57 | 711 | 726 | 1064.5625 | 2127.1104 | 2127.1074 | 1.41 | G | 0 | 16 | 0.025 | FGHYTSIAKQVLLALE +dK_MMCCH-2 (K) | 719 |
| 58 | 825 | 841 | 820.7039 | 2459.0898 | 2459.0780 | 4.76 | G | 1 | 26 | 0.0028 | HSVPFNVFDYKTNFNVE +Deamidated (NQ); dK_MMCCH-2 (K) | 835 |
| 59 | 847 | 860 | 643.6771 | 1928.0095 | 1928.0077 | 0.93 | G | 0 | 26 | 0.0024 | FNGLSJSQLNKKLE +dK_MMCCH-2 (K) | 858 |
| 60 | 942 | 972 | 955.5030 | 3817.9829 | 3817.9614 | 5.63 | G | 3 | 17 | 0.019 | VFDLKPASLGKDLFKQPSVIHEPRIGHHEGE +dK_MMCCH-2 (K) | 946 |
| 61 | 942 | 970 | 727.3867 | 3631.8972 | 3631.8973 | -0.03 | G | 2 | 32 | 0.0007 | VFDLKPASLGKDLFKQPSVIHEPRIGHHE +dK_MMCCH-2 (K) | 956 |
| 62 | 1055 | 1076 | 810.1674 | 3236.6403 | 3236.6402 | 0.03 | G | 1 | 32 | 0.00065 | NALLKKGSSVAVPYWDWTKRIE +2 dK_MMCCH-2 (K) | 1059, 1060 |

Figure 22 continued

| 63 | 1055 | 1076 | 725.6326 | 2898.5012 | 2898.5102 | -3.11 | G | 1 | 38 | 0.00018 | NALLKKGSSVAVPYWDWTKRIE +dK_MMCCH-2 (K) | 1060 |
| 64 | 1097 | 1108 | 878.4210 | 1754.8275 | 1754.8199 | 4.33 | G | 0 | 22 | 0.0064 | TNPFHHGKITHE +dK_MMCCH-2 (K) | 1104 |
| 65 | 1376 | 1396 | 864.3891 | 2590.1455 | 2590.1428 | 1.04 | G | 3 | 21 | 0.0072 | AGTDSAHTDDGHTEPVMIRKD +dK_MMCCH-2 (K) | 1395 |
| 66 | 1397 | 1413 | 774.4356 | 2320.2848 | 2320.2824 | 1.03 | G | 1 | 29 | 0.0012 | ITQLDKRQQLSLVKALE +dK_MMCCH-2 (K) | 1410 |
| 67 | 1506 | 1522 | 753.3769 | 2257.1088 | 2257.1089 | -0.04 | G | 2 | 19 | 0.013 | TGRDIPNPFIGSKIEFE +dK_MMCCH-2 (K) | 1518 |
| 68 | 1755 | 1765 | 570.6054 | 1708.7944 | 1708.7013 | 1.81 | G | 2 | 26 | 0.0027 | TLDKMNLRHDE +dK_MMCCH-2 (K) | 1758 |
| 69 | 2059 | 2078 | 692.5998 | 2766.3703 | 2766.3588 | 4.16 | G | 1 | 15 | 0.032 | INHNQFTKKHAVPNDVFKYE +dK_MMCCH-2 (K) | 2076 |
| 70 | 2089 | 2100 | 854.4097 | 1706.8048 | 1706.8008 | 2.34 | G | 2 | 22 | 0.0065 | IGGMNLHEIEKE +dK_MMCCH-2 (K) | 2099 |
| 71 | 2647 | 2661 | 715.6793 | 2144.0161 | 2144.0095 | 3.08 | G | 4 | 24 | 0.0037 | AEELRDALYKLQNDE +dK_MMCCH-2 (K) | 2656 |
| 72 | 3090 | 3097 | 632.8041 | 1263.5937 | 1263.5879 | 4.59 | G | 0 | 13 | 0.048 | LGKMYSVE +dK_MMCCH-2 (K) | 3092 |
| 73 | 59 | 68 | 721.3473 | 1440.6800 | 1440.6781 | 1.32 | C | 1 | 37 | 0.0002 | VLGGPSEMKW +dK_MMCCH-2 (K) | 67 |
| 74 | 94 | 100 | 573.2999 | 1144.5853 | 1144.5838 | 1.31 | C | 1 | 15 | 0.031 | TVKAELF +dK_MMCCH-2 (K) | 96 |
| 75 | 429 | 450 | 990.8061 | 2969.3964 | 2969.3899 | 2.22 | C | 1 | 21 | 0.0078 | GGISLENIEKMIHENQQEDRIY +dK_MMCCH-2 (K); Oxidation (M) | 438 |
| 76 | 468 | 481 | 935.9773 | 1869.9400 | 1869.9295 | 5.62 | C | 0 | 19 | 0.014 | IKTTDSVQHKAGTF +dK_MMCCH-2 (K) | 469 |
| 77 | 584 | 595 | 787.4001 | 1572.7876 | 1572.7858 | 1.14 | C | 2 | 40 | 9.10E-05 | ALLKEDKSAGGF +dK_MMCCH-2 (K) | 590 |
| 78 | 715 | 722 | 599.3331 | 1196.6516 | 1196.6475 | 3.43 | C | 0 | 22 | 0.006 | TSIAKQVL +dK_MMCCH-2 (K) | 719 |
| 79 | 783 | 788 | 544.7778 | 1087.5410 | 1087.5372 | 3.49 | C | 1 | 26 | 0.0025 | QALQKY +dK_MMCCH-2 (K) | 787 |
| 80 | 830 | 838 | 743.3410 | 1484.6674 | 1484.6646 | 1.89 | C | 2 | 19 | 0.013 | NVFDYKTNF +dK_MMCCH-2 (K) | 835 |
| 81 | 1013 | 1018 | 516.7590 | 1031.5034 | 1031.4998 | 3.49 | C | 0 | 14 | 0.044 | ESIAKF +dK_MMCCH-2 (K) | 1017 |
| 82 | 1072 | 1087 | 744.7218 | 2231.1436 | 2231.1409 | 1.21 | C | 1 | 16 | 0.024 | TKRIEHLPHLISDATY +dK_MMCCH-2 (K) | 1073 |
| 83 | 1330 | 1337 | 620.3563 | 1238.6980 | 1238.6944 | 2.83 | C | 1 | 24 | 0.0036 | KLDITKAL +dK_MMCCH-2 (K) | 1335 |
| 84 | 1649 | 1664 | 752.3297 | 2253.9673 | 2253.9637 | 1.60 | C | 2 | 18 | 0.015 | NLNDHTHDFSKPEDTF +dK_MMCCH-2 (K) | 1659 |
| 85 | 1732 | 1742 | 792.8754 | 1583.7363 | 1583.7364 | -0.06 | C | 1 | 17 | 0.02 | TVLGGEKEMPW +dK_MMCCH-2 (K) | 1738 |

Figure 22 continued

| | | | | | | | | | | |
|---|---|---|---|---|---|---|---|---|---|---|
| 86 | 1818 | 1827 | 753.3691 | 1504.7237 | 1504.7232 | 0.40 | C | 1 | 21 | 0.0074 | SERDIGSLKY +dK_MMCCH-2 (K) | 1826 |
| 87 | 2160 | 2184 | 1085.5110 | 3253.5111 | 3253.5179 | -2.09 | C | 3 | 18 | 0.015 | KYDITHALHDAHITPEDVFHPSEPF +dK_MMCCH-2 (K) | 2160 |
| 88 | 2476 | 2488 | 923.9221 | 1845.8296 | 1845.8244 | 2.82 | C | 1 | 22 | 0.0062 | THSNAKPTDVFEY +dK_MMCCH-2 (K) | 2481 |
| 89 | 2656 | 2666 | 793.3529 | 1584.6913 | 1584.6879 | 2.15 | C | 1 | 29 | 0.0013 | KLQNDESHGGY +dK_MMCCH-2 (K) | 2656 |
| 90 | 2738 | 2749 | 856.3752 | 1710.7358 | 1710.7348 | 0.58 | C | 2 | 19 | 0.012 | ADSGNNNPFFKY +dK_MMCCH-2 (K) | 2748 |
| 91 | 2750 | 2779 | 1289.6239 | 3865.8499 | 3865.8621 | -3.18 | C | 3 | 22 | 0.0058 | HIRSINQDTVRDVNEAIfQQTKFGEFSSIf +2 Deamidated (NQ); dK_MMCCH-2 (K) | 2771 |
| 92 | 2799 | 2815 | 744.3796 | 2230.1169 | 2230.1092 | 3.45 | C | 2 | 24 | 0.0042 | EILHNEVHALIGGAEKY +dK_MMCCH-2 (K) | 2814 |
| 93 | 2946 | 2960 | 965.4055 | 1928.7965 | 1928.7986 | -1.09 | C | 1 | 26 | 0.0023 | IKSGTDSDDEYAGSF +dK_MMCCH-2 (K) | 2947 |
| 94 | 2961 | 2971 | 769.8917 | 1537.7689 | 1537.7673 | 1.04 | C | 1 | 17 | 0.019 | VILGGAKEMPW +dK_MMCCH-2 (K) | 2967 |
| 95 | 1 | 8 | 643.8054 | 1285.5963 | 1285.5934 | 2.26 | Th | 1 | 22 | 0.006 | MTPEELKT +dK_MMCCH-2 (K) | 7 |
| 96 | 38 | 56 | 861.6811 | 2582.0214 | 2582.0108 | 4.11 | Th | 2 | 14 | 0.041 | VCIPDDNDRNDDHCEKAGD +dK_MMCCH-2 (K) | 53 |
| 97 | 59 | 69 | 785.3774 | 1568.7402 | 1568.7357 | 2.23 | Th | 3 | 55 | 2.90E-06 | VLGGPSEMKWQ +dK_MMCCH-2 (K) | 67 |
| 98 | 78 | 84 | 569.2881 | 1136.5616 | 1136.5536 | 7.04 | Th | 1 | 47 | 2.10E-05 | LSDTVHK +dK_MMCCH-2 (K) | 84 |
| 99 | 117 | 124 | 620.8133 | 1239.6120 | 1239.6070 | 4.03 | Th | 1 | 23 | 0.0052 | VVHHPEKG +dK_MMCCH-2 (K) | 123 |
| 100 | 431 | 438 | 642.3345 | 1282.6545 | 1282.6479 | 5.15 | Th | 2 | 29 | 0.0013 | ISLENIEK +dK_MMCCH-2 (K) | 438 |
| 101 | 521 | 530 | 707.8455 | 1413.6764 | 1413.6698 | 4.67 | Th | 2 | 74 | 4.30E-08 | VDITEVDGTK +dK_MMCCH-2 (K) | 530 |
| 102 | 585 | 591 | 585.8113 | 1169.6080 | 1169.6002 | 6.67 | Th | 1 | 35 | 0.00032 | LLKEDKS +dK_MMCCH-2 (K) | 590 |
| 103 | 601 | 612 | 904.8973 | 1807.7801 | 1807.7698 | 5.70 | Th | 1 | 22 | 0.0058 | FHGEPKWCPSPE +dK_MMCCH-2 (K) | 606 |
| 104 | 666 | 672 | 607.2841 | 1212.5537 | 1212.5485 | 4.29 | Th | 2 | 24 | 0.0043 | LADHEKY +dK_MMCCH-2 (K) | 671 |
| 105 | 673 | 685 | 930.4190 | 1858.8235 | 1858.8196 | 2.10 | Th | 2 | 15 | 0.035 | VDPEDGVEKHNPW +dK_MMCCH-2 (K) | 681 |
| 106 | 821 | 828 | 617.8143 | 1233.6141 | 1233.6064 | 6.24 | Th | 1 | 14 | 0.036 | VTKEHSVP +dK_MMCCH-2 (K) | 823 |
| 107 | 831 | 837 | 612.7885 | 1223.5623 | 1223.5533 | 7.44 | Th | 2 | 18 | 0.016 | VFDYKTN +dK_MMCCH-2 (K) | 835 |

Figure 22 continued

| 108 | 954 | 959 | 529.7656 | 1057.5167 | 1057.5154 | 1.23 | Th | 1 | 13 | 0.048 | LFKQPS +Deamidated (NQ); dK_MMCCH-2 (K) | 956 |
| --- | --- | --- | --- | --- | --- | --- | --- | --- | --- | --- | --- | --- |
| 109 | 1100 | 1104 | 482.2296 | 962.4447 | 962.4433 | 1.45 | Th | 0 | 18 | 0.015 | FHHGK +dK_MMCCH-2 (K) | 1104 |
| 110 | 1219 | 1232 | 653.9534 | 1958.8383 | 1958.8316 | 3.42 | Th | 1 | 21 | 0.0077 | FDKSDNNDEATKTH +dK_MMCCH-2 (K) | 1230 |
| 111 | 1580 | 1587 | 572.7740 | 1143.5334 | 1143.5271 | 5.60 | Th | 1 | 15 | 0.029 | VGGKEPYG +dK_MMCCH-2 (K) | 1583 |
| 112 | 1657 | 1668 | 921.9191 | 1841.8236 | 1841.8182 | 2.93 | Th | 2 | 32 | 0.00063 | FSKPEDTFDYQK +dK_MMCCH-2 (K) | 1659 |
| 113 | 1657 | 1668 | 921.9192 | 1841.8238 | 1841.8182 | 3.04 | Th | 2 | 46 | 2.70E-05 | FSKPEDTFDYQK +dK_MMCCH-2 (K) | 1668 |
| 114 | 1733 | 1741 | 664.3235 | 1326.6325 | 1326.6312 | 1.06 | Th | 2 | 30 | 0.00096 | VLGGEKEMP +dK_MMCCH-1 (K); Oxidation (M) | 1738 |
| 115 | 1894 | 1904 | 850.4174 | 1698.8203 | 1698.8116 | 5.12 | Th | 5 | 40 | 9.40E-05 | VAVPYWDWTKP +dK_MMCCH-2 (K) | 1903 |
| 116 | 2064 | 2068 | 499.7604 | 997.5061 | 997.5055 | 0.60 | Th | 0 | 17 | 0.02 | FTKKH +dK_MMCCH-2 (K) | 2067 |
| 117 | 2094 | 2100 | 618.3057 | 1234.5969 | 1234.5903 | 5.35 | Th | 1 | 30 | 0.001 | LHEIEKE +dK_MMCCH-2 (K) | 2099 |
| 118 | 2129 | 2141 | 933.8789 | 1865.7433 | 1865.7495 | -3.32 | Th | 0 | 19 | 0.012 | ICKTSEDCHHGGQ +dK_MMCCH-2 (K) | 2131 |
| 119 | 2238 | 2248 | 778.8803 | 1555.7459 | 1555.7440 | 1.29 | Th | 3 | 43 | 5.00E-05 | LTTAEVDNLKD +dK_MMCCH-2 (K) | 2247 |
| 120 | 2480 | 2487 | 622.7991 | 1243.5836 | 1243.5795 | 3.30 | Th | 2 | 13 | 0.046 | AKPTDVFE +dK_MMCCH-2 (K) | 2481 |
| 121 | 2512 | 2521 | 807.3992 | 1612.7838 | 1612.7766 | 4.40 | Th | 0 | 32 | 0.00068 | LEKQKEEDRT +dK_MMCCH-2 (K) | 2514 |
| 122 | 2595 | 2606 | 806.4045 | 1610.7945 | 1610.7862 | 5.15 | Th | 2 | 26 | 0.0026 | IDTSGKQLPSD +dK_MMCCH-2 (K) | 2601 |
| 123 | 2607 | 2612 | 520.7803 | 1039.5461 | 1039.5446 | 1.44 | Th | 2 | 22 | 0.0057 | LIKMPT +dK_MMCCH-2 (K) | 2609 |
| 124 | 2766 | 2771 | 551.7865 | 1101.5584 | 1101.5529 | 5.08 | Th | 1 | 27 | 0.002 | IFQQTK +dK_MMCCH-2 (K) | 2771 |
| 125 | 2808 | 2816 | 638.3196 | 1274.6247 | 1274.6217 | 2.43 | Th | 3 | 21 | 0.0084 | LIGGAEKYS +dK_MMCCH-2 (K) | 2814 |
| 126 | 2946 | 2960 | 965.4089 | 1928.8032 | 1928.7986 | 2.38 | Th | 3 | 34 | 0.0004 | IKSGTDSDDEYAGSF +dK_MMCCH-2 (K) | 2947 |
| 127 | 2990 | 2996 | 583.2845 | 1164.5545 | 1164.5485 | 5.15 | Th | 1 | 38 | 0.00017 | LTDDHVK +dK_MMCCH-2 (K) | 2996 |

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1043.0238 | 2084.0330 | 2084.0347 | -0.82 | T | 1 | 70 | 9.50E-08 | KNVDSLSSDEVLALEK +dK_MMCCH-2 (K) | 26 |
| 2 | 147 | 155 | 694.3724 | 1386.7302 | 1386.7217 | 6.13 | T | 1 | 27 | 0.0018 | ADITFLNKK +dK_MMCCH-2 (K) | 155 |
| 3 | 164 | 175 | 596.3090 | 1785.9051 | 1785.8985 | 3.70 | T | 1 | 37 | 0.00018 | LFEKVQPGHHTR +dK_MMCCH-2 (K) | 167 |
| 4 | 249 | 271 | 987.4413 | 2959.3020 | 2959.3051 | -1.05 | T | 1 | 32 | 0.00058 | GKDPNSADCAHNLIHTPMEPFDR +dK_MMCCH-2 (K) | 250 |
| 5 | 281 | 293 | 610.9457 | 1829.8152 | 1829.8043 | 5.96 | T | 0 | 54 | 3.90E-06 | EHAKPADSFDYGR +dK_MMCCH-2 (K) | 284 |
| 6 | 419 | 446 | 677.3701 | 3381.8139 | 3381.8132 | 0.21 | T | 1 | 45 | 3.20E-05 | QPTLVHRPAKGHFDKPPVPVAQANLAVR +Deamidated (NQ); dK_MMCCH-2 (K) | 428 |
| 7 | 429 | 446 | 752.0657 | 2253.1752 | 2253.1729 | 1.02 | T | 0 | 52 | 5.70E-06 | GHFDKPPVPVAQANLAVR +dK_MMCCH-2 (K) | 433 |
| 8 | 467 | 488 | 944.4583 | 2830.3529 | 2830.3385 | 5.12 | T | 1 | 71 | 8.30E-08 | FQNDKSVDGYQATVEFHALPAR +dK_MMCCH-2 (K) | 471 |
| 9 | 788 | 795 | 718.8198 | 1435.6251 | 1435.6377 | -8.78 | T | 1 | 15 | 0.029 | EMKWGFDR +dK_MMCCH-1 (K); Oxidation (M) | 790 |
| 10 | 936 | 950 | 1080.0140 | 2158.0135 | 2158.0095 | 1.85 | T | 1 | 51 | 8.20E-06 | KHGFTGGLPYWDWTR +dK_MMCCH-2 (K) | 936 |
| 11 | 995 | 1052 | 1170.7135 | 7018.2375 | 7018.2306 | 0.98 | T | 1 | 15 | 0.032 | DDLYQSPFGHYTDIAKQVLLAFEQDDFEVQFEIAHNFIHALVGGNEPYSMS SLR +dK_MMCCH-2 (K) | 1011 |
| 12 | 1082 | 1096 | 996.4618 | 1990.9090 | 1990.9063 | 1.36 | T | 0 | 77 | 2.00E-08 | GKPYNTANCAIASMR +dK_MMCCH-2 (K) | 1083 |
| 13 | 1097 | 1115 | 827.0768 | 2478.2087 | 2478.2101 | -0.56 | T | 0 | 84 | 3.90E-09 | KPLQPFGLDSVINPDDETR +dK_MMCCH-2 (K) | 1097 |
| 14 | 1123 | 1149 | 1190.5595 | 3568.6565 | 3568.6497 | 1.93 | T | 1 | 73 | 5.50E-08 | VFDYKNNFDYEYESLAFNGLSIAQLDR +dK_MMCCH-2 (K) | 1127 |
| 15 | 1295 | 1311 | 764.0672 | 2289.1798 | 2289.1715 | 3.63 | T | 1 | 17 | 0.021 | SAFLQIQKEGIYENIAK +dK_MMCCH-2 (K) | 1302 |
| 16 | 1355 | 1385 | 1271.2711 | 3810.7915 | 3810.7876 | 1.05 | T | 1 | 44 | 3.90E-05 | GSAVAVPYWDWTEKADSLPSLINDATYFNSR +dK_MMCCH-2 (K) | 1368 |
| 17 | 1409 | 1450 | 1097.7112 | 5483.5195 | 5483.5213 | -0.33 | T | 1 | 33 | 0.00047 | DPQPELWDNKDFYENVMLALEQDNFCDFEIQLELIHNALHSR +dK_MMCCH-2 (K) | 1418 |

| | | | | | | | | | |
|---|---|---|---|---|---|---|---|---|---|
| 18 | 1455 | 1480 | 1117.8726 | 3350.5959 | 3350.6070 | -3.34 | T | 1 | 63 | 5.50E-07 | AKYSLSSLDYTAFDPVFFLHHANVDR +dK_MMCCH-2 (K) | 1456 |
| 19 | 1493 | 1507 | 721.6653 | 2161.9742 | 2161.9594 | 6.80 | T | 1 | 59 | 1.20E-06 | KKPYNEADCAVNEMR +dK_MMCCH-2 (K) | 1493 |
| 20 | 1493 | 1507 | 721.6612 | 2161.9617 | 2161.9594 | 1.06 | T | 1 | 70 | 9.40E-08 | KKPYNEADCAVNEMR +dK_MMCCH-2 (K) | 1494 |
| 21 | 1508 | 1526 | 837.7524 | 2510.2353 | 2510.2185 | 6.69 | T | 0 | 20 | 0.01 | KPLQPFNNPELNSDSMTLK +dK_MMCCH-2 (K) | 1508 |
| 22 | 1508 | 1539 | 825.9995 | 4124.9612 | 4124.9360 | 6.08 | T | 1 | 23 | 0.0047 | KPLQPFNNPELNSDSMTLKHNLPQDSFDYQNR +dK_MMCCH-2 (K) | 1526 |
| 23 | 1542 | 1564 | 802.8925 | 3207.5407 | 3207.5448 | -1.25 | T | 1 | 19 | 0.012 | YQYDNLQFNHFSIQKLDQTIQAR +dK_MMCCH-2 (K) | 1556 |
| 24 | 1622 | 1633 | 591.9809 | 1772.9209 | 1772.9171 | 2.14 | T | 1 | 18 | 0.015 | LYKFDITSALHK +dK_MMCCH-2 (K) | 1624 |
| 25 | 1690 | 1700 | 786.9194 | 1571.8243 | 1571.8116 | 8.08 | T | 1 | 13 | 0.049 | KEVSSLTTLEK +dK_MMCCH-2 (K) | 1690 |
| 26 | 1690 | 1704 | 532.2905 | 2125.1328 | 2125.1241 | 4.05 | T | 2 | 28 | 0.0015 | KEVSSLTTLEKHFLR +dK_MMCCH-2 (K) | 1700 |
| 27 | 1757 | 1768 | 612.9786 | 1835.9141 | 1835.9128 | 0.71 | T | 1 | 19 | 0.013 | LYTVQFEDSLKR +dK_MMCCH-2 (K) | 1767 |
| 28 | 1769 | 1803 | 1108.3084 | 4429.2045 | 4429.1882 | 3.70 | T | 0 | 28 | 0.0015 | HGSIVGLPYWDWLKPQSALPDLVTQETYEHLFSHK +dK_MMCCH-2 (K) | 1803 |
| 29 | 1804 | 1825 | 945.4654 | 2833.3743 | 2833.3633 | 3.92 | T | 1 | 23 | 0.0047 | TFPNPFLKANIEFEGEGVTTER +dK_MMCCH-2 (K) | 1811 |
| 30 | 1949 | 1963 | 560.2515 | 2236.9767 | 2236.9735 | 1.43 | T | 0 | 57 | 1.90E-06 | TQEFSKPEDTFDYHR +dK_MMCCH-2 (K) | 1954 |
| 31 | 2045 | 2052 | 660.3513 | 1318.6880 | 1318.6843 | 2.81 | T | 1 | 18 | 0.015 | YDITKTLK +dK_MMCCH-2 (K) | 2049 |
| 32 | 2116 | 2125 | 715.3626 | 1428.7107 | 1428.7105 | 0.14 | T | 1 | 15 | 0.029 | DLASLKSAMR +dK_MMCCH-2 (K) | 2121 |
| 33 | 2228 | 2239 | 870.4226 | 1738.8305 | 1738.8236 | 3.97 | T | 1 | 28 | 0.0017 | GYIKSEDAYTVR +dK_MMCCH-2 (K) | 2231 |
| 34 | 2453 | 2463 | 839.9324 | 1677.8502 | 1677.8436 | 3.93 | T | 1 | 17 | 0.021 | NFKYDITQALK +dK_MMCCH-2 (K) | 2455 |
| 35 | 2527 | 2541 | 1007.5171 | 2013.0196 | 2013.0088 | 5.37 | T | 1 | 86 | 2.60E-09 | KDVTSLTASEIENLR +dK_MMCCH-2 (K) | 2527 |
| 36 | 2728 | 2739 | 957.9996 | 1913.9846 | 1913.9862 | -0.84 | T | 1 | 32 | 0.00059 | IWAIWQALQKYR +Deamidated (NQ); dK_MMCCH-2 (K) | 2737 |
| 37 | 2755 | 2764 | 764.3816 | 1526.7486 | 1526.7439 | 3.08 | T | 0 | 23 | 0.0053 | QPLKPFSESR +Deamidated (NQ); dK_MMCCH-2 (K) | 2758 |
| 38 | 3148 | 3155 | 629.3348 | 1256.6551 | 1256.6587 | -2.86 | T | 1 | 15 | 0.032 | KKPYNAAK +dK_MMCCH-2 (K) | 3149 |
| 39 | 167 | 178 | 590.9649 | 1769.8729 | 1769.8705 | 1.30 | G | 0 | 44 | 4.00E-05 | KVQPGHHTRLME +dK_MMCCH-2 (K) | 167 |
| 40 | 318 | 322 | 456.7347 | 911.4549 | 911.4535 | 1.54 | G | 0 | 17 | 0.021 | RAAKE +dK_MMCCH-2 (K) | 321 |

Figure 22 continued

| | | | | | | | | | |
|---|---|---|---|---|---|---|---|---|---|
| 41 | 433 | 456 | 975.8586 | 2924.5539 | 2924.5429 | 3.76 | G | 2 | 20 | 0.011 | KPPVPVAQANLAVRKNINDLTAEE +dK_MMCCH-2 (K) | 433 |
| 42 | 466 | 481 | 1098.4976 | 2194.9806 | 2194.9841 | -1.59 | G | 2 | 29 | 0.0013 | RFQNDKSVDGYQATVE +Deamidated (NQ); dK_MMCCH-2 (K) | 471 |
| 43 | 1215 | 1235 | 721.6069 | 2882.3986 | 2882.3949 | 1.28 | G | 3 | 23 | 0.0054 | ITQQLHDLDLHVGDNFFLKYE +dK_MMCCH-2 (K) | 1233 |
| 44 | 1292 | 1303 | 879.4658 | 1756.9170 | 1756.9182 | -0.68 | G | 0 | 49 | 1.20E-05 | SIRSAFLQIQKE +dK_MMCCH-2 (K) | 1302 |
| 45 | 1308 | 1320 | 904.9478 | 1807.8811 | 1807.8749 | 3.37 | G | 0 | 23 | 0.0051 | NIAKFHGKPGLCE +dK_MMCCH-2 (K) | 1311 |
| 46 | 1308 | 1320 | 603.6335 | 1807.8786 | 1807.8749 | 2.05 | G | 0 | 28 | 0.0014 | NIAKFHGKPGLCE +dK_MMCCH-2 (K) | 1315 |
| 47 | 1403 | 1422 | 921.4202 | 2761.2387 | 2761.2330 | 2.06 | G | 3 | 19 | 0.012 | NAVTSRDPQPELWDNKDFYE +dK_MMCCH-2 (K) | 1418 |
| 48 | 1952 | 1967 | 792.6824 | 2375.0255 | 2375.0205 | 2.11 | G | 3 | 35 | 0.00028 | FSKPEDTFDYHRFGYE +dK_MMCCH-2 (K) | 1954 |
| 49 | 1973 | 1990 | 811.7271 | 2432.1595 | 2432.1505 | 3.74 | G | 0 | 16 | 0.023 | FVGMSVSSLHNYIKQQQE +dK_MMCCH-2 (K) | 1986 |
| 50 | 2477 | 2484 | 644.8342 | 1287.6538 | 1287.6573 | -2.72 | G | 0 | 25 | 0.0034 | APFFIKVE +dK_MMCCH-2 (K) | 2482 |
| 51 | 3386 | 3405 | 877.4154 | 2629.2244 | 2629.2271 | -1.03 | G | 2 | 29 | 0.0013 | LDHAYSLRDGHYYIAGPTKD +dK_MMCCH-2 (K) | 3404 |
| 52 | 38 | 55 | 1181.0338 | 2360.0531 | 2360.0478 | 2.25 | C | 3 | 27 | 0.0019 | ALEKALDLQQDDSNQGY +dK_MMCCH-2 (K) | 41 |
| 53 | 152 | 165 | 667.6938 | 2000.0595 | 2000.0513 | 4.10 | C | 2 | 14 | 0.041 | LNKKTSRAVDDRLF +dK_MMCCH-2 (K) | 154 |
| 54 | 166 | 176 | 547.2856 | 1638.8349 | 1638.8300 | 2.99 | C | 0 | 21 | 0.008 | EKVQPGHHTRL +dK_MMCCH-2 (K) | 167 |
| 55 | 277 | 296 | 883.7525 | 2648.2357 | 2648.2329 | 1.02 | C | 4 | 45 | 3.50E-05 | DLTREHAKPADSFDYGRLGY +dK_MMCCH-2 (K) | 284 |
| 56 | 364 | 373 | 735.3609 | 1468.7072 | 1468.7094 | -1.50 | C | 2 | 22 | 0.0056 | LLGGPTEMKW +dK_MMCCH-2 (K) | 372 |
| 57 | 629 | 635 | 539.2520 | 1076.4895 | 1076.4848 | 4.27 | C | 0 | 26 | 0.0027 | VGGSEKY +dK_MMCCH-2 (K) | 634 |
| 58 | 1007 | 1015 | 669.8715 | 1337.7284 | 1337.7265 | 1.42 | C | 1 | 26 | 0.0024 | TDIAKQVLL +dK_MMCCH-2 (K) | 1011 |
| 59 | 1075 | 1080 | 544.7778 | 1087.5410 | 1087.5372 | 3.49 | C | 1 | 26 | 0.0025 | QALQKY +dK_MMCCH-2 (K) | 1079 |
| 60 | 1125 | 1139 | 1128.4790 | 2254.9434 | 2254.9405 | 1.33 | C | 5 | 18 | 0.016 | DYKNNFDYEYESLAF +dK_MMCCH-2 (K) | 1127 |
| 61 | 1298 | 1312 | 824.0845 | 2469.2316 | 2469.2324 | -0.32 | C | 2 | 26 | 0.0023 | LQIQKEGIYENIAKF +2 dK_MMCCH-2 (K) | 1302, 1311 |
| 62 | 1298 | 1312 | 711.3758 | 2131.1055 | 2131.1023 | 1.50 | C | 2 | 27 | 0.0021 | LQIQKEGIYENIAKF +dK_MMCCH-2 (K) | 1311 |
| 63 | 1526 | 1534 | 712.3406 | 1422.6667 | 1422.6602 | 4.57 | C | 0 | 15 | 0.03 | KHNLPQDSF +dK_MMCCH-2 (K) | 1526 |

Figure 22 continued

| | | | | | | | | | | |
|---|---|---|---|---|---|---|---|---|---|---|
| 64 | 1589 | 1606 | 784.3575 | 2350.0506 | 2350.0392 | 4.85 | C | 0 | 13 | 0.05 | ICVEQGGEQNCKTKAGSF +dK_MMCCH-2 (K) | 1600 |
| 65 | 1589 | 1606 | 784.3556 | 2350.0451 | 2350.0392 | 2.51 | C | 0 | 32 | 0.00069 | ICVEQGGEQNCKTKAGSF +dK_MMCCH-2 (K) | 1602 |
| 66 | 1696 | 1702 | 607.3020 | 1212.5894 | 1212.5849 | 3.71 | C | 1 | 20 | 0.011 | TTLEKHF +dK_MMCCH-2 (K) | 1700 |
| 67 | 1708 | 1719 | 839.8415 | 1677.6685 | 1677.6651 | 2.09 | C | 0 | 17 | 0.019 | KNMQADDSPDGY +dK_MMCCH-2 (K) | 1708 |
| 68 | 1782 | 1796 | 1014.5055 | 2026.9964 | 2026.9921 | 2.12 | C | 1 | 31 | 0.00075 | KPQSALPDLVTQETY +dK_MMCCH-2 (K) | 1782 |
| 69 | 1801 | 1809 | 706.8381 | 1411.6617 | 1411.6595 | 1.56 | C | 0 | 16 | 0.024 | SHKTPNPF +dK_MMCCH-2 (K) | 1803 |
| 70 | 1953 | 1964 | 627.2849 | 1878.8327 | 1878.8247 | 4.26 | C | 2 | 18 | 0.017 | SKPEDTFDYHRF +dK_MMCCH-2 (K) | 1954 |
| 71 | 1985 | 1995 | 850.4291 | 1698.8437 | 1698.8399 | 2.24 | C | 0 | 30 | 0.0011 | IKQQQEADRVF +dK_MMCCH-2 (K) | 1986 |
| 72 | 2001 | 2011 | 726.8453 | 1451.6761 | 1451.6755 | 0.41 | C | 1 | 21 | 0.008 | KGFGQSASVSF +dK_MMCCH-2 (K) | 2001 |
| 73 | 2455 | 2462 | 645.3257 | 1288.6369 | 1288.6373 | -0.31 | C | 1 | 24 | 0.0038 | KYDITQAL +dK_MMCCH-2 (K) | 2455 |
| 74 | 2463 | 2479 | 1128.0194 | 2254.0243 | 2254.0253 | -0.44 | C | 1 | 19 | 0.011 | KAQSIHPEDVFDTDAPF +dK_MMCCH-2 (K) | 2463 |
| 75 | 2506 | 2532 | 761.6026 | 3042.3813 | 3042.3738 | 2.47 | C | 0 | 24 | 0.0042 | SAGEGHTDDHGSDHIAGSGVRKDVTSL +dK_MMCCH-2 (K) | 2527 |
| 76 | 2754 | 2760 | 598.3314 | 1194.6483 | 1194.6471 | 1.00 | C | 1 | 17 | 0.022 | KQPLKPF +dK_MMCCH-2 (K) | 2754 |
| 77 | 2754 | 2760 | 598.3325 | 1194.6504 | 1194.6471 | 2.76 | C | 1 | 17 | 0.022 | KQPLKPF +dK_MMCCH-2 (K) | 2758 |
| 78 | 2865 | 2872 | 673.3662 | 1344.7179 | 1344.7112 | 4.98 | C | 1 | 22 | 0.0064 | RYDITKVL +dK_MMCCH-2 (K) | 2870 |
| 79 | 3235 | 3242 | 617.3142 | 1232.6139 | 1232.6111 | 2.27 | C | 0 | 30 | 0.0009 | TSANVKIY +dK_MMCCH-2 (K) | 3240 |
| 80 | 3398 | 3406 | 658.3369 | 1314.6593 | 1314.6530 | 4.79 | C | 1 | 15 | 0.029 | YIAGPTKDL +dK_MMCCH-2 (K) | 3404 |
| 81 | 69 | 75 | 604.2940 | 1206.5735 | 1206.5703 | 2.65 | Th | 0 | 13 | 0.045 | VDKHEKN +dK_MMCCH-2 (K) | 74 |
| 82 | 184 | 191 | 703.8044 | 1405.5942 | 1405.5894 | 3.41 | Th | 1 | 43 | 4.90E-05 | LEQDEFCK +dK_MMCCH-2 (K) | 191 |
| 83 | 247 | 260 | 631.6201 | 1891.8384 | 1891.8305 | 4.12 | Th | 2 | 21 | 0.0078 | LRGKDPNSADCAHN +dK_MMCCH-2 (K) | 250 |
| 84 | 283 | 293 | 782.8576 | 1563.7006 | 1563.7028 | -1.34 | Th | 3 | 47 | 1.80E-05 | AKPADSFDYGR +dK_MMCCH-2 (K) | 284 |
| 85 | 364 | 374 | 763.8729 | 1525.7312 | 1525.7309 | 0.20 | Th | 3 | 33 | 0.00046 | LLGGPTEMKWG +dK_MMCCH-2 (K) | 372 |
| 86 | 629 | 636 | 582.7682 | 1163.5219 | 1163.5169 | 4.38 | Th | 1 | 20 | 0.01 | VGGSEKYS +dK_MMCCH-2 (K) | 634 |

Figure 22 continued

| | Start | End | Mr(calc) | Mr(expt) | ppm | Enzyme | Score | E | Peptide | Mod_site |
|---|---|---|---|---|---|---|---|---|---|---|
| 87 | 893 | 904 | 904.8973 | 1807.7801 | 1807.7698 | 5.70 | Th | 1 | 22 | 0.0058 | FHGEPKWCPSPE +dK_MMCCH-2 (K) | 898 |
| 88 | 1362 | 1374 | 968.4312 | 1934.8479 | 1934.8397 | 4.24 | Th | 4 | 13 | 0.045 | YWDWTEKADSLPS +dK_MMCCH-2 (K) | 1368 |
| 89 | 1525 | 1539 | 738.3572 | 2212.0497 | 2212.0371 | 5.70 | Th | 3 | 36 | 0.00026 | LKHNLPQDSFDYQNR +dK_MMCCH-2 (K) | 1526 |
| 90 | 1589 | 1605 | 848.0453 | 2541.1142 | 2541.1008 | 5.27 | Th | 2 | 19 | 0.013 | iCVEQGGEQNCKTKAGS +2 dK_MMCCH-2 (K) | 1600, 1602 |
| 91 | 1589 | 1605 | 735.3340 | 2202.9801 | 2202.9708 | 4.22 | Th | 2 | 38 | 0.00015 | iCVEQGGEQNCKTKAGS +dK_MMCCH-2 (K) | 1602 |
| 92 | 1643 | 1648 | 537.7640 | 1073.5135 | 1073.5103 | 2.98 | Th | 2 | 14 | 0.037 | FDIKVD +dK_MMCCH-2 (K) | 1646 |
| 93 | 1800 | 1809 | 780.3752 | 1558.7359 | 1558.7279 | 5.13 | Th | 2 | 20 | 0.01 | FSHKTFPNPF +dK_MMCCH-2 (K) | 1803 |
| 94 | 1952 | 1963 | 627.2850 | 1878.8331 | 1878.8247 | 4.47 | Th | 2 | 55 | 3.40E-06 | FSKPEDTFDYHR +dK_MMCCH-2 (K) | 1954 |
| 95 | 1985 | 1993 | 727.3631 | 1452.7116 | 1452.7031 | 5.92 | Th | 1 | 21 | 0.0072 | IKQQQEADR +dK_MMCCH-2 (K) | 1986 |
| 96 | 2193 | 2199 | 667.3032 | 1332.5918 | 1332.5849 | 5.18 | Th | 2 | 24 | 0.0037 | YWDWTKP +dK_MMCCH-2 (K) | 2198 |
| 97 | 2200 | 2206 | 562.3082 | 1122.6018 | 1122.5995 | 2.05 | Th | 2 | 22 | 0.0062 | ISKLPDL +dK_MMCCH-2 (K) | 2202 |
| 98 | 2225 | 2229 | 462.2221 | 922.4297 | 922.4259 | 4.23 | Th | 2 | 21 | 0.0072 | FAKGY +dK_MMCCH-2 (K) | 2227 |
| 99 | 2359 | 2363 | 509.2315 | 1016.4485 | 1016.4460 | 2.46 | Th | 1 | 26 | 0.0028 | FTKMH +dK_MMCCH-2 (K); Oxidation (M) | 2361 |
| 100 | 2941 | 2950 | 720.8409 | 1439.6673 | 1439.6602 | 4.93 | Th | 3 | 45 | 3.00E-05 | LDEANDLKNA +dK_MMCCH-2 (K) | 2948 |
| 101 | 3009 | 3015 | 573.2771 | 1144.5396 | 1144.5335 | 5.33 | Th | 0 | 16 | 0.022 | LKEHGSH +dK_MMCCH-2 (K) | 3010 |
| 102 | 3399 | 3405 | 520.2615 | 1038.5084 | 1038.5056 | 2.70 | Th | 1 | 29 | 0.0011 | iAGPTKD +dK_MMCCH-2 (K) | 3404 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the lysine conjugation site for KLH1 or KLH2.

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 124 | 141 | 785.4092 | 2353.2059 | 2353.2001 | 2.46 | T | 1 | 25 | 0.0032 | GFTDPPVKHHQSANLVR +dK_MMCCH-2 (K) | 131 |
| 2 | 142 | 149 | 656.3431 | 1310.6716 | 1310.6653 | 4.88 | T | 1 | 33 | 0.00048 | KNINDLTR +dK_MMCCH-2 (K) | 142 |
| 3 | 157 | 166 | 822.8833 | 1643.7520 | 1643.7402 | 7.18 | T | 1 | 18 | 0.014 | EAFHKFQEDR +dK_MMCCH-2 (K) | 161 |
| 4 | 184 | 192 | 726.8424 | 1451.6701 | 1451.6649 | 3.58 | T | 1 | 20 | 0.009 | CPRPDAKDR +dK_MMCCH-2 (K) | 190 |
| 5 | 553 | 560 | 663.8682 | 1325.7219 | 1325.7166 | 4.00 | T | 2 | 20 | 0.011 | VKFDKVPR +dK_MMCCH-2 (K) | 554 |
| 6 | 566 | 570 | 485.2449 | 968.4752 | 968.4749 | 0.31 | T | 1 | 16 | 0.025 | KNVDR +dK_MMCCH-2 (K) | 566 |
| 7 | 581 | 590 | 733.9201 | 1465.8256 | 1465.8214 | 2.93 | T | 2 | 24 | 0.0038 | KALALLKEDK +dK_MMCCH-2 (K) | 581 |
| 8 | 588 | 606 | 781.0359 | 2340.0858 | 2340.0845 | 0.60 | T | 1 | 26 | 0.0025 | EDKSAGGFQQLGAFHGEPK +dK_MMCCH-2 (K) | 590 |
| 9 | 645 | 681 | 1158.5337 | 4630.1057 | 4630.1063 | -0.15 | T | 1 | 25 | 0.0032 | HGYDGALPYWDWTSPLNHLPELADHEKYVDPEDGVEK +dK_MMCCH-2 (K) | 671 |
| 10 | 682 | 699 | 620.2917 | 2477.1377 | 2477.1434 | -2.34 | T | 1 | 18 | 0.015 | HNPWFDGHIDTVDKTTTR +dK_MMCCH-2 (K) | 695 |
| 11 | 700 | 719 | 887.7701 | 2660.2886 | 2660.2945 | -2.22 | T | 1 | 48 | 1.60E-05 | SVQNKLFEQEPFGHYTSIAK +dK_MMCCH-2 (K) | 704 |
| 12 | 778 | 789 | 958.0007 | 1913.9869 | 1913.9862 | 0.37 | T | 1 | 22 | 0.0059 | IWAIWQALQKYR +Deamidated (NQ); dK_MMCCH-2 (K) | 787 |
| 13 | 790 | 804 | 1003.4695 | 2004.9244 | 2004.9220 | 1.20 | T | 0 | 56 | 2.60E-06 | GKPYNVANCAVTSMR +dK_MMCCH-2 (K) | 791 |
| 14 | 858 | 863 | 520.2990 | 1038.5835 | 1038.5783 | 4.91 | T | 1 | 16 | 0.024 | KLEAIK +dK_MMCCH-2 (K) | 858 |
| 15 | 953 | 965 | 635.3314 | 1902.9723 | 1902.9662 | 3.15 | T | 1 | 54 | 3.60E-06 | DLFKQPSVIHEPR +dK_MMCCH-2 (K) | 956 |
| 16 | 986 | 1000 | 1027.0338 | 2052.0531 | 2052.0561 | -1.46 | T | 1 | 51 | 8.60E-06 | KNIENLSLGELESLR +dK_MMCCH-2 (K) | 986 |
| 17 | 1048 | 1060 | 913.5288 | 1825.0431 | 1825.0423 | 0.44 | T | 1 | 37 | 0.00021 | LYVVVENALLKK +dK_MMCCH-2 (K) | 1060 |
| 18 | 1092 | 1114 | 791.8768 | 3163.4780 | 3163.4682 | 3.07 | T | 1 | 38 | 0.00017 | QHHYETNPFHHGKITHENEJTTR +dK_MMCCH-2 (K) | 1104 |

| | | | | | | | | | |
|---|---|---|---|---|---|---|---|---|---|
| 19 | 1199 | 1203 | 353.1911 | 1056.5514 | 1056.5538 | -2.37 | T | 1 | 17 | 0.019 | KRPYR +dK_MMCCH-2 (K) | 1199 |
| 20 | 1331 | 1338 | 620.3545 | 1238.6944 | 1238.6944 | 0.00 | T | 1 | 24 | 0.0039 | LDITKALK +dK_MMCCH-2 (K) | 1335 |
| 21 | 1395 | 1402 | 649.8365 | 1297.6585 | 1297.6588 | -0.15 | T | 1 | 21 | 0.0078 | KDITQLDK +dK_MMCCH-2 (K) | 1395 |
| 22 | 1473 | 1489 | 778.4027 | 2332.1863 | 2332.1827 | 1.54 | T | 1 | 47 | 2.00E-05 | KHGAVVGLPYWDWTLPR +dK_MMCCH-2 (K) | 1473 |
| 23 | 1721 | 1746 | 1087.4764 | 3259.4075 | 3259.3937 | 4.23 | T | 1 | 13 | 0.047 | TAGDCEDAGYFTVLGGEKEMPWAFDR +dK_MMCCH-2 (K) | 1738 |
| 24 | 1747 | 1758 | 613.9770 | 1838.9091 | 1838.9012 | 4.35 | T | 1 | 21 | 0.0079 | LYKYDITETLDK +dK_MMCCH-2 (K) | 1749 |
| 25 | 1923 | 1932 | 756.3808 | 1510.7470 | 1510.7425 | 3.04 | T | 1 | 27 | 0.0019 | NKVMPNPFAR +dK_MMCCH-2 (K) | 1924 |
| 26 | 2100 | 2109 | 492.2468 | 1964.9580 | 1964.9601 | -1.07 | T | 2 | 19 | 0.014 | EIKDKQHHVR +2 dK_MMCCH-2 (K) | 2102, 2104 |
| 27 | 2121 | 2149 | 1186.8922 | 3557.6548 | 3557.6378 | 4.78 | T | 1 | 46 | 2.80E-05 | TSADVQFQICKTSEDCHHGGQIPVLGGTK +dK_MMCCH-2 (K) | 2131 |
| 28 | 2359 | 2367 | 736.3499 | 1470.6853 | 1470.6853 | 2.72 | T | 1 | 35 | 0.00031 | DKLFNDPER +dK_MMCCH-2 (K) | 2360 |
| 29 | 2507 | 2514 | 682.3525 | 1362.6905 | 1362.6853 | 3.82 | T | 1 | 27 | 0.0019 | KLEHELEK +dK_MMCCH-2 (K) | 2507 |
| 30 | 2515 | 2520 | 571.7622 | 1141.5099 | 1141.5074 | 2.19 | T | 1 | 18 | 0.017 | QKEEDR +dK_MMCCH-2 (K) | 2516 |
| 31 | 2595 | 2609 | 983.5306 | 1965.0467 | 1965.0493 | -1.27 | T | 1 | 21 | 0.0081 | IIDTSGKQLPSDLIK +dK_MMCCH-2 (K) | 2601 |
| 32 | 2621 | 2636 | 802.7113 | 2405.1121 | 2405.1083 | 1.54 | T | 1 | 55 | 3.00E-06 | HHEKHHEDHHEDILVR +dK_MMCCH-2 (K) | 2624 |
| 33 | 2637 | 2651 | 1069.5327 | 2137.0509 | 2137.0374 | 6.27 | T | 1 | 71 | 8.70E-08 | KNIHSLSHHEAEELR +dK_MMCCH-2 (K) | 2637 |
| 34 | 2761 | 2814 | 1324.8373 | 6619.1500 | 6619.1192 | 4.65 | T | 1 | 13 | 0.046 | DVNEAIFQQTKFGEFSSIFYLALQALEEDNYCDFEVQYEILHNEVHALIGGAEK +dK_MMCCH-2 (K) | 2771 |
| 35 | 2851 | 2883 | 1009.2160 | 4032.8349 | 4032.8346 | 0.07 | T | 0 | 30 | 0.001 | VKPAHAGSCAGDIMHVPLHPFNYESVNNDDFTR +dK_MMCCH-2 (K) | 2852 |
| 36 | 2897 | 2919 | 1066.5197 | 3196.5371 | 3196.5287 | 2.63 | T | 1 | 59 | 1.30E-06 | FNYKYDNLNLHGHNIEELEEVLR +dK_MMCCH-2 (K) | 2900 |
| 37 | 2999 | 3021 | 1106.2400 | 3315.6981 | 3315.6923 | 1.75 | T | 2 | 21 | 0.0071 | FDLKKYDHTELDASVLPAPIIVR +2 dK_MMCCH-2 (K) | 3002, 3003 |
| 38 | 3003 | 3021 | 825.7711 | 2474.2914 | 2474.2879 | 1.37 | T | 1 | 27 | 0.0022 | KYDHTELDASVLPAPIIVR +dK_MMCCH-2 (K) | 3003 |
| 39 | 123 | 151 | 616.6606 | 3693.9202 | 3693.9049 | 4.14 | G | 2 | 30 | 0.00099 | KGFTDPPVKHHQSANLLVRKNINDLTREE +dK_MMCCH-2 (K) | 123 |
| 40 | 123 | 151 | 616.6599 | 3693.9154 | 3693.9049 | 2.84 | G | 2 | 23 | 0.005 | KGFTDPPVKHHQSANLLVRKNINDLTREE +dK_MMCCH-2 (K) | 131 |

Figure 23 continued

| | | | | | | | | | |
|---|---|---|---|---|---|---|---|---|---|
| 41 | 158 | 176 | 846.3828 | 2536.1266 | 2536.1329 | -2.48 | G | 3 | 24 | 0.0038 | AFHKFQEDRSVDGYQATAE +dK_MMCCH-2 (K) | 161 |
| 42 | 435 | 442 | 676.3245 | 1350.6344 | 1350.6312 | 2.37 | G | 1 | 18 | 0.015 | NIEKMIHE +dK_MMCCH-2 (K) | 438 |
| 43 | 526 | 544 | 777.7501 | 2330.2285 | 2330.2304 | -0.82 | G | 1 | 24 | 0.0044 | VDGTKLASSLIPHASVIRE +dK_MMCCH-2 (K) | 530 |
| 44 | 589 | 612 | 1102.8262 | 3305.4567 | 3305.4621 | -1.63 | G | 1 | 34 | 0.00039 | DKSAGGFQQLGAFHGEPKWCPSPE +2 dK_MMCCH-2 (K) | 590, 606 |
| 45 | 589 | 612 | 990.1141 | 2967.3206 | 2967.3320 | -3.84 | G | 1 | 23 | 0.0055 | DKSAGGFQQLGAFHGEPKWCPSPE +dK_MMCCH-2 (K) | 606 |
| 46 | 666 | 676 | 827.3729 | 1652.7313 | 1652.7302 | -4.78 | C | 2 | 14 | 0.038 | LADHEKYVDPE +dK_MMCCH-2 (K) | 671 |
| 47 | 825 | 841 | 820.3713 | 2458.0922 | 2458.0940 | -0.73 | G | 1 | 25 | 0.003 | HSVPFNVFDYKTNFNYE +dK_MMCCH-2 (K) | 835 |
| 48 | 847 | 860 | 643.6777 | 1928.0112 | 1928.0077 | 1.82 | G | 0 | 24 | 0.0043 | FNGLSJSQLNKKLE +dK_MMCCH-2 (K) | 858 |
| 49 | 942 | 970 | 727.3804 | 3631.8658 | 3631.8973 | -8.70 | G | 2 | 18 | 0.016 | VFDLKPASLGKDLFKQPSVIHEPRIGHHE +dK_MMCCH-2 (K) | 956 |
| 50 | 1055 | 1076 | 810.1655 | 3236.6328 | 3236.6402 | -2.32 | G | 1 | 30 | 0.00092 | NALLKKGSSVAVPYWDWTKRIE +2 dK_MMCCH-2 (K) | 1059, 1060 |
| 51 | 1055 | 1076 | 725.6326 | 2898.5012 | 2898.5102 | -3.11 | G | 1 | 37 | 0.0002 | NALLKKGSSVAVPYWDWTKRIE +dK_MMCCH-2 (K) | 1060 |
| 52 | 1097 | 1110 | 999.9615 | 1997.9085 | 1997.9054 | 1.60 | G | 1 | 22 | 0.0062 | TNPFHHGKITHENE +dK_MMCCH-2 (K) | 1104 |
| 53 | 1376 | 1396 | 864.3896 | 2590.1471 | 2590.1428 | 1.66 | G | 3 | 22 | 0.0067 | AGTDSAHTDDGHTEPVMIRKD +dK_MMCCH-2 (K) | 1395 |
| 54 | 1376 | 1413 | 915.2663 | 4571.2951 | 4571.2636 | 6.89 | G | 5 | 21 | 0.0079 | AGTDSAHTDDGHTEPVMIRKDITQLDKRQQLSLVKALE +Deamidated (NQ); dK_MMCCH-2 (K); Oxidation (M) | 1402 |
| 55 | 1397 | 1413 | 774.4324 | 2320.2753 | 2320.2824 | -3.06 | G | 1 | 22 | 0.006 | ITQLDKRQQLSLVKALE +dK_MMCCH-2 (K) | 1410 |
| 56 | 1506 | 1522 | 753.3741 | 2257.1004 | 2257.1089 | -3.77 | G | 2 | 21 | 0.0076 | TGRDIPNPFIGSKIEFE +dK_MMCCH-2 (K) | 1518 |
| 57 | 1755 | 1765 | 570.6044 | 1708.7915 | 1708.7913 | 0.12 | G | 2 | 27 | 0.0019 | TLDKMNLRHDE +dK_MMCCH-2 (K) | 1758 |
| 58 | 2089 | 2100 | 854.4117 | 1706.8088 | 1706.8008 | 4.75 | G | 2 | 41 | 7.40E-05 | IGGMNLHEIEKE +dK_MMCCH-2 (K) | 2099 |
| 59 | 2647 | 2661 | 715.6783 | 2144.0130 | 2144.0095 | 1.63 | G | 4 | 24 | 0.0043 | AEELRDALYKLQNDE +dK_MMCCH-2 (K) | 2656 |
| 60 | 3090 | 3097 | 632.8027 | 1263.5908 | 1263.5879 | 2.30 | G | 0 | 14 | 0.039 | LGKMYSVE +dK_MMCCH-2 (K) | 3092 |
| 61 | 59 | 68 | 721.3470 | 1440.6794 | 1440.6781 | 0.90 | C | 1 | 33 | 0.00045 | VLGGPSEMKW +dK_MMCCH-2 (K) | 67 |
| 62 | 160 | 171 | 909.9108 | 1817.8070 | 1817.8043 | 1.49 | C | 1 | 19 | 0.014 | HKFQEDRSVDGY +dK_MMCCH-2 (K) | 161 |

Figure 23 continued

| | | | | | | | | | |
|---|---|---|---|---|---|---|---|---|---|
| 63 | 584 | 595 | 787.4013 | 1572.7879 | 1572.7858 | 1.40 | C | 2 | 36 | 0.00027 | ALLKEDKSAGGF +dK_MMCCH-2 (K) | 590 |
| 64 | 715 | 723 | 655.8733 | 1309.7320 | 1309.7316 | 0.38 | C | 1 | 15 | 0.032 | TSJAKQVLL +dK_MMCCH-2 (K) | 719 |
| 65 | 783 | 788 | 544.7770 | 1087.5394 | 1087.5372 | 2.02 | C | 1 | 18 | 0.017 | QALQKY +dK_MMCCH-2 (K) | 787 |
| 66 | 860 | 869 | 789.8865 | 1577.7584 | 1577.7548 | 2.28 | C | 1 | 13 | 0.045 | EAIKSQDRFF +dK_MMCCH-2 (K) | 863 |
| 67 | 944 | 955 | 821.4309 | 1640.8473 | 1640.8484 | -0.67 | C | 3 | 15 | 0.035 | DLKPASLGKDLF +dK_MMCCH-2 (K) | 946 |
| 68 | 1013 | 1018 | 516.7577 | 1031.5009 | 1031.4998 | 1.16 | C | 0 | 22 | 0.0065 | ESIAKF +dK_MMCCH-2 (K) | 1017 |
| 69 | 1330 | 1337 | 620.3552 | 1238.6958 | 1238.6944 | 1.05 | C | 1 | 21 | 0.0071 | KLDITKAL +dK_MMCCH-2 (K) | 1335 |
| 70 | 1515 | 1521 | 566.2921 | 1130.5697 | 1130.5682 | 1.33 | C | 0 | 17 | 0.022 | IGSKIEF +dK_MMCCH-2 (K) | 1518 |
| 71 | 1649 | 1664 | 752.3290 | 2253.9651 | 2253.9637 | 0.62 | C | 2 | 15 | 0.034 | NLNDHTHDFSKPEDTF +dK_MMCCH-2 (K) | 1659 |
| 72 | 1818 | 1827 | 753.3682 | 1504.7218 | 1504.7232 | -0.93 | C | 1 | 21 | 0.0077 | SERDIGSLKY +dK_MMCCH-2 (K) | 1826 |
| 73 | 2076 | 2082 | 612.3054 | 1222.5962 | 1222.5944 | 1.47 | C | 3 | 19 | 0.014 | KYELLGY +dK_MMCCH-2 (K) | 2076 |
| 74 | 2160 | 2184 | 1085.5089 | 3253.5049 | 3253.5179 | -4.00 | C | 3 | 32 | 0.00064 | KYDITHALHDAHITPEDVFHPSEPF +dK_MMCCH-2 (K) | 2150 |
| 75 | 2476 | 2488 | 923.9213 | 1845.8280 | 1845.8244 | 1.95 | C | 1 | 26 | 0.0025 | THSNAKPTDVFEY +dK_MMCCH-2 (K) | 2481 |
| 76 | 2656 | 2672 | 747.3419 | 2239.0039 | 2239.0004 | 1.56 | C | 2 | 30 | 0.001 | KLQNDESHGGYEHIAGF +dK_MMCCH-2 (K) | 2656 |
| 77 | 2738 | 2749 | 856.3748 | 1710.7350 | 1710.7348 | 0.12 | C | 2 | 21 | 0.0074 | ADSGWNNPFFKY +dK_MMCCH-2 (K) | 2748 |
| 78 | 2946 | 2960 | 965.4052 | 1928.7957 | 1928.7986 | -1.50 | C | 1 | 21 | 0.0072 | IKSGTDSDDEYAGSF +dK_MMCCH-2 (K) | 2947 |
| 79 | 2964 | 2971 | 607.2726 | 1212.5306 | 1212.5307 | -0.08 | C | 0 | 17 | 0.02 | GGAKEMPW +dK_MMCCH-2 (K) | 2967 |
| 80 | 1 | 9 | 733.3323 | 1464.6500 | 1464.6516 | -1.09 | Th | 2 | 19 | 0.014 | MTPEELKTY +dK_MMCCH-2 (K); Oxidation (M) | 7 |
| 81 | 38 | 56 | 861.6808 | 2582.0205 | 2582.0108 | 3.76 | Th | 2 | 17 | 0.019 | VCIPDDNDRNDDHCEKAGD +dK_MMCCH-2 (K) | 53 |
| 82 | 59 | 69 | 785.3759 | 1568.7371 | 1568.7367 | 0.25 | Th | 3 | 52 | 6.90E-06 | VLGGPSEMKWQ +dK_MMCCH-2 (K) | 67 |
| 83 | 78 | 84 | 569.2864 | 1136.5583 | 1136.5536 | 4.14 | Th | 1 | 34 | 0.00041 | LSDTVHK +dK_MMCCH-2 (K) | 84 |
| 84 | 117 | 124 | 620.8127 | 1239.6109 | 1239.6070 | 3.15 | Th | 1 | 24 | 0.0044 | VVHHPEKG +dK_MMCCH-2 (K) | 123 |
| 85 | 431 | 439 | 715.8506 | 1429.6866 | 1429.6833 | 2.38 | Th | 3 | 16 | 0.027 | ISLENIEKM +dK_MMCCH-2 (K); Oxidation (M) | 438 |

Figure 23 continued

| # | | | | | | | | | | |
|---|---|---|---|---|---|---|---|---|---|---|
| 86 | 521 | 530 | 707.8433 | 1413.6720 | 1413.6698 | 1.56 | Th | 2 | 69 | 1.10E-07 | VDITEVDGTK +dK_MMCCH-2 (K) | 530 |
| 87 | 585 | 591 | 585.8104 | 1169.6062 | 1169.6002 | 5.13 | Th | 1 | 35 | 0.00033 | LLKEDKS +dK_MMCCH-2 (K) | 590 |
| 88 | 601 | 612 | 904.8962 | 1807.7779 | 1807.7698 | 4.48 | Th | 1 | 18 | 0.018 | FHGEPKWCPSPE +dK_MMCCH-2 (K) | 606 |
| 89 | 666 | 672 | 607.2816 | 1212.5486 | 1212.5485 | 0.08 | Th | 2 | 23 | 0.0045 | LADHEKY +dK_MMCCH-2 (K) | 671 |
| 90 | 821 | 828 | 617.8116 | 1233.6086 | 1233.6064 | 1.78 | Th | 1 | 23 | 0.005 | VTKEHSVP +dK_MMCCH-2 (K) | 823 |
| 91 | 831 | 837 | 612.7867 | 1223.5588 | 1223.5533 | 4.50 | Th | 2 | 22 | 0.007 | VFDYKTN +dK_MMCCH-2 (K) | 835 |
| 92 | 1100 | 1104 | 482.2287 | 962.4428 | 962.4433 | -0.52 | Th | 0 | 20 | 0.0093 | FHHGK +dK_MMCCH-2 (K) | 1104 |
| 93 | 1111 | 1120 | 742.3818 | 1482.7491 | 1482.7388 | 6.95 | Th | 1 | 22 | 0.0066 | ITTRDPKDSL +dK_MMCCH-2 (K) | 1117 |
| 94 | 1156 | 1164 | 630.8400 | 1259.6654 | 1259.6584 | 5.56 | Th | 2 | 14 | 0.038 | LLGGKGKYS +dK_MMCCH-2 (K) | 1162 |
| 95 | 1219 | 1232 | 653.9541 | 1958.8405 | 1958.8316 | 4.54 | Th | 1 | 30 | 0.0011 | FDKSDNNDEATKTH +dK_MMCCH-2 (K) | 1221 |
| 96 | 1219 | 1232 | 980.4238 | 1958.8330 | 1958.8316 | 0.71 | Th | 1 | 37 | 0.0002 | FDKSDNNDEATKTH +dK_MMCCH-2 (K) | 1230 |
| 97 | 1580 | 1587 | 572.7732 | 1143.5319 | 1143.5271 | 4.28 | Th | 1 | 16 | 0.023 | VGGKEPYG +dK_MMCCH-2 (K) | 1583 |
| 98 | 1657 | 1668 | 921.9167 | 1841.8189 | 1841.8182 | 0.38 | Th | 2 | 49 | 1.30E-05 | FSKPEDTFDYQK +dK_MMCCH-2 (K) | 1659 |
| 99 | 1657 | 1668 | 921.9177 | 1841.8208 | 1841.8182 | 1.41 | Th | 2 | 56 | 2.20E-06 | FSKPEDTFDYQK +dK_MMCCH-2 (K) | 1668 |
| 100 | 1733 | 1741 | 664.3229 | 1326.6313 | 1326.6312 | 0.08 | Th | 2 | 17 | 0.02 | VLGGEKEMP +dK_MMCCH-1 (K); Oxidation (M) | 1738 |
| 101 | 1756 | 1760 | 479.7244 | 957.4342 | 957.4300 | 4.49 | Th | 1 | 16 | 0.024 | LDKMN +dK_MMCCH-2 (K) | 1758 |
| 102 | 1894 | 1904 | 850.4153 | 1698.8161 | 1698.8116 | 2.65 | Th | 5 | 42 | 5.60E-05 | VAVPWVDWTKP +dK_MMCCH-2 (K) | 1903 |
| 103 | 2064 | 2068 | 499.7591 | 997.5036 | 997.5055 | -2.01 | Th | 0 | 18 | 0.014 | FTKKH +dK_MMCCH-2 (K) | 2067 |
| 104 | 2094 | 2100 | 618.3030 | 1234.5914 | 1234.5903 | 0.89 | Th | 1 | 27 | 0.0022 | LHEIEKE +dK_MMCCH-2 (K) | 2099 |
| 105 | 2129 | 2141 | 933.8804 | 1865.7462 | 1865.7495 | -1.77 | Th | 0 | 25 | 0.0035 | ICKTSEDCHHGGQ +dK_MMCCH-2 (K) | 2131 |
| 106 | 2238 | 2248 | 778.8785 | 1555.7425 | 1555.7440 | -0.90 | Th | 3 | 44 | 4.10E-05 | LTTAEVDNLKD +dK_MMCCH-2 (K) | 2247 |
| 107 | 2475 | 2487 | 915.9249 | 1829.8353 | 1829.8295 | 3.22 | Th | 3 | 17 | 0.018 | FTHSNAKPTDVFE +dK_MMCCH-2 (K) | 2481 |
| 108 | 2512 | 2521 | 807.3982 | 1612.7819 | 1612.7766 | 3.29 | Th | 0 | 35 | 0.00033 | LEKQKEEDRT +dK_MMCCH-2 (K) | 2514 |

Figure 23 continued

| 109 | 2508 | 2521 | 708.0113 | 2121.0120 | 2121.0048 | 3.44 | Th | 1 | 14 | 0.042 | LEHELEKQKEEDRT +dK_MMCCH-2 (K) | 2516 |
|---|---|---|---|---|---|---|---|---|---|---|---|---|
| 110 | 2595 | 2606 | 806.4034 | 1610.7923 | 1610.7862 | 3.79 | Th | 2 | 35 | 0.00033 | IIDTSGKQLPSD +dK_MMCCH-2 (K) | 2601 |
| 111 | 2607 | 2612 | 520.7794 | 1039.5443 | 1039.5446 | -0.29 | Th | 2 | 22 | 0.0058 | LIKMPT +dK_MMCCH-2 (K) | 2609 |
| 112 | 2766 | 2771 | 551.7853 | 1101.5561 | 1101.5529 | 3.00 | Th | 1 | 24 | 0.0043 | IFQQTK +dK_MMCCH-2 (K) | 2771 |
| 113 | 2808 | 2816 | 638.3184 | 1274.6223 | 1274.6217 | 0.47 | Th | 3 | 27 | 0.0018 | LIGGAEKYS +dK_MMCCH-2 (K) | 2814 |
| 114 | 2946 | 2960 | 965.4048 | 1928.7950 | 1928.7986 | -1.87 | Th | 3 | 30 | 0.001 | IKSGTDSDDEYAGSF +dK_MMCCH-2 (K) | 2947 |
| 115 | 2990 | 2996 | 583.2842 | 1164.5538 | 1164.5485 | 4.55 | Th | 1 | 38 | 0.00016 | LTDDHVK +dK_MMCCH-2 (K) | 2996 |
| 116 | 3076 | 3084 | 724.3623 | 1446.7100 | 1446.7040 | 4.22 | Th | 2 | 13 | 0.046 | FKCKVPPFS +dK_MMCCH-2 (K) | 3079 |

Figure 23 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1043.0241 | 2084.0335 | 2084.0347 | -0.58 | T | 1 | 44 | 3.80E-05 | KNVDSLSSDEVLALEK +dK_MMCCH-2 (K) | 26 |
| 2 | 147 | 155 | 694.3694 | 1386.7242 | 1386.7217 | 1.80 | T | 1 | 22 | 0.006 | ADITFLNKK +dK_MMCCH-2 (K) | 155 |
| 3 | 164 | 175 | 596.3101 | 1785.9085 | 1785.8985 | 5.66 | T | 1 | 44 | 4.40E-05 | LFEKVQPGHHTR +dK_MMCCH-2 (K) | 167 |
| 4 | 249 | 271 | 987.4429 | 2959.3068 | 2959.3051 | 0.57 | T | 1 | 33 | 0.00051 | GKDPNSADCAHNLJHTPMEPFDR +dK_MMCCH-2 (K) | 250 |
| 5 | 281 | 293 | 610.9435 | 1829.8088 | 1829.8043 | 2.46 | T | 0 | 56 | 2.70E-06 | EHAKPADSFDYGR +dK_MMCCH-2 (K) | 284 |
| 6 | 419 | 446 | 846.4591 | 3381.8073 | 3381.8132 | -1.74 | T | 1 | 24 | 0.0038 | QPTLVHRPAKGHFDKPPVPVAQANLAVR +Deamidated (NQ); dK_MMCCH-2 (K) | 428 |
| 7 | 429 | 446 | 752.0663 | 2253.1770 | 2253.1729 | 1.86 | T | 0 | 52 | 7.00E-06 | GHFDKPPVPVAQANLAVR +dK_MMCCH-2 (K) | 433 |
| 8 | 467 | 488 | 708.5934 | 2830.3444 | 2830.3385 | 2.08 | T | 1 | 65 | 2.90E-07 | FQNDKSVDGYQATVEFHALPAR +dK_MMCCH-2 (K) | 471 |
| 9 | 489 | 497 | 726.8424 | 1451.6701 | 1451.6649 | 3.58 | T | 1 | 20 | 0.009 | CPRPDAKDR +dK_MMCCH-2 (K) | 495 |
| 10 | 936 | 950 | 1080.0117 | 2158.0089 | 2158.0095 | -0.28 | T | 1 | 46 | 2.60E-05 | KHGFTGGLPYWDWTR +dK_MMCCH-2 (K) | 936 |
| 11 | 1082 | 1096 | 996.4610 | 1990.9074 | 1990.9063 | 0.60 | T | 0 | 85 | 3.00E-09 | GKPYNTANCAIASMR +dK_MMCCH-2 (K) | 1083 |
| 12 | 1097 | 1115 | 827.0761 | 2478.2065 | 2478.2101 | -1.45 | T | 0 | 56 | 2.60E-06 | KPLQPFGLDSVINPDDETR +dK_MMCCH-2 (K) | 1097 |
| 13 | 1123 | 1149 | 1190.5605 | 3568.6598 | 3568.6497 | 2.86 | T | 1 | 63 | 5.20E-07 | VFDYKNNFDYEYESLAFNGLSIAQLDR +dK_MMCCH-2 (K) | 1127 |
| 14 | 1355 | 1385 | 1271.2697 | 3810.7871 | 3810.7876 | -0.10 | T | 1 | 27 | 0.0019 | GSAVAVPYWDWTEKADSLPSLINDATYFNSR +dK_MMCCH-2 (K) | 1368 |
| 15 | 1409 | 1450 | 1371.8883 | 5483.5241 | 5483.5213 | 0.51 | T | 1 | 54 | 4.10E-06 | DPQPELWDNKDFYENVMLALEQDNFCDFEIQLELIHNALHSR +dK_MMCCH-2 (K) | 1418 |
| 16 | 1455 | 1480 | 1117.8800 | 3350.6182 | 3350.6070 | 3.31 | T | 1 | 42 | 6.00E-05 | AKYSLSSLDYTAFDPVFLHHANVDR +dK_MMCCH-2 (K) | 1456 |
| 17 | 1493 | 1507 | 721.6616 | 2161.9629 | 2161.9594 | 1.57 | T | 1 | 62 | 6.50E-07 | KKPYNEADCAVNEMR +dK_MMCCH-2 (K) | 1494 |
| 18 | 1542 | 1564 | 1070.1942 | 3207.5608 | 3207.5448 | 4.99 | T | 1 | 33 | 0.00048 | YQYDNLQFNHFSIQKLDQTIQAR +dK_MMCCH-2 (K) | 1556 |

Figure 23 continued

| | | | | | | | | | |
|---|---|---|---|---|---|---|---|---|---|
| 19 | 1691 | 1704 | 999.5225 | 1997.0305 | 1997.0292 | 0.65 | T | 1 | 23 | 0.0055 | EVSSLTTLEKHFLR +dK_MMCCH-2 (K) | 1700 |
| 20 | 1757 | 1768 | 612.9788 | 1835.9146 | 1835.9128 | 1.03 | T | 1 | 16 | 0.025 | LYTVQFEDSLKR +dK_MMCCH-2 (K) | 1767 |
| 21 | 1804 | 1825 | 945.4641 | 2833.3705 | 2833.3633 | 2.54 | T | 1 | 39 | 0.00014 | TFPNPFLKANIEFEGEGVTTER +dK_MMCCH-2 (K) | 1811 |
| 22 | 1949 | 1963 | 1119.4961 | 2236.9776 | 2236.9735 | 1.83 | T | 1 | 45 | 3.30E-05 | TQEFSKPEDTFDYHR +dK_MMCCH-2 (K) | 1954 |
| 23 | 2228 | 2239 | 870.4186 | 1738.8227 | 1738.8236 | -0.52 | T | 0 | 16 | 0.026 | GYIKSEDAYTVR +dK_MMCCH-2 (K) | 2231 |
| 24 | 2527 | 2541 | 1007.5152 | 2013.0158 | 2013.0088 | 3.48 | T | 1 | 79 | 1.40E-08 | KDVTSLTASEIENLR +dK_MMCCH-2 (K) | 2527 |
| 25 | 2728 | 2739 | 958.0007 | 1913.9869 | 1913.9862 | 0.37 | T | 1 | 22 | 0.0059 | IWAIWQALQKYR +Deamidated (NQ); dK_MMCCH-2 (K) | 2737 |
| 26 | 2755 | 2764 | 764.3814 | 1526.7483 | 1526.7439 | 2.88 | T | 0 | 33 | 0.00051 | QPLKPFSESR +Deamidated (NQ); dK_MMCCH-2 (K) | 2758 |
| 27 | 2866 | 2873 | 659.3627 | 1316.7108 | 1316.7050 | 4.40 | T | 1 | 21 | 0.0089 | YDITKVLK +dK_MMCCH-2 (K) | 2870 |
| 28 | 3148 | 3155 | 629.3356 | 1256.6567 | 1256.6587 | -1.59 | T | 1 | 19 | 0.013 | KKPYNAAK +dK_MMCCH-2 (K) | 3149 |
| 29 | 167 | 178 | 590.9629 | 1769.8668 | 1769.8705 | -2.09 | T | 0 | 38 | 0.00014 | KVQPGHHTRLME +dK_MMCCH-2 (K) | 167 |
| 30 | 433 | 456 | 975.8492 | 2924.5259 | 2924.5429 | -5.81 | G | 2 | 16 | 0.025 | KPPVPVAQANLAVRKNINDLTAEE +dK_MMCCH-2 (K) | 433 |
| 31 | 466 | 481 | 732.3397 | 2193.9972 | 2194.0001 | -1.32 | G | 2 | 25 | 0.0032 | RFQNDKSVDGYQATVE +dK_MMCCH-2 (K) | 471 |
| 32 | 1117 | 1135 | 1404.1260 | 2806.2374 | 2806.2373 | 0.04 | G | 3 | 16 | 0.024 | HSVPFRVFDYKNNFDYEYE +dK_MMCCH-2 (K) | 1127 |
| 33 | 1215 | 1235 | 721.6066 | 2882.3974 | 2882.3949 | 0.87 | G | 3 | 25 | 0.0031 | ITQQLHDLDLHVGDNFFLKYE +dK_MMCCH-2 (K) | 1233 |
| 34 | 1292 | 1303 | 879.4659 | 1756.9173 | 1756.9182 | -0.46 | G | 0 | 42 | 5.80E-05 | SIRSAFLQIQKE +dK_MMCCH-2 (K) | 1302 |
| 35 | 1308 | 1320 | 904.9471 | 1807.8797 | 1807.8749 | 2.66 | G | 0 | 21 | 0.0082 | NIAKFHGKPGLCE +dK_MMCCH-2 (K) | 1311 |
| 36 | 1308 | 1320 | 603.6324 | 1807.8755 | 1807.8749 | 0.33 | G | 0 | 26 | 0.0026 | NIAKFHGKPGLCE +dK_MMCCH-2 (K) | 1315 |
| 37 | 1952 | 1967 | 792.6802 | 2375.0187 | 2375.0205 | -0.76 | G | 3 | 34 | 0.00037 | FSKPEDTFDYHRFGYE +dK_MMCCH-2 (K) | 1954 |
| 38 | 1973 | 1990 | 811.7253 | 2432.1540 | 2432.1505 | 1.48 | G | 0 | 14 | 0.041 | FVGMSVSSLHNYIKQQQE +dK_MMCCH-2 (K) | 1986 |
| 39 | 2471 | 2484 | 990.9680 | 1979.9215 | 1979.9227 | -0.61 | G | 3 | 22 | 0.0069 | DVFDTDAPFFIKVE +dK_MMCCH-2 (K) | 2482 |
| 40 | 3386 | 3405 | 658.3167 | 2629.2377 | 2629.2271 | 4.03 | G | 2 | 31 | 0.00087 | LDHAYSLRDGHYIAGPTKD +dK_MMCCH-2 (K) | 3404 |
| 41 | 153 | 165 | 629.9987 | 1886.9742 | 1886.9673 | 3.66 | C | 1 | 15 | 0.031 | NKKTSRAVDDRLF +dK_MMCCH-2 (K) | 154 |

Figure 23 continued

| | | | | | | | | | |
|---|---|---|---|---|---|---|---|---|---|
| 42 | 277 | 296 | 883.7534 | 2648.2384 | 2648.2329 | 2.08 | C | 4 | 41 | 8.10E-05 | DLTREHAKPADSFDYGRLGY +dK_MMCCH-2 (K) | 284 |
| 43 | 364 | 373 | 735.3599 | 1468.7052 | 1468.7094 | -2.93 | C | 2 | 29 | 0.0012 | LLGGPTEMKW +dK_MMCCH-2 (K) | 372 |
| 44 | 432 | 443 | 793.9158 | 1585.8171 | 1585.8174 | -0.19 | C | 0 | 16 | 0.027 | DKPPVPVAQANL +dK_MMCCH-2 (K) | 433 |
| 45 | 629 | 635 | 539.2513 | 1076.4881 | 1076.4848 | 3.07 | C | 0 | 16 | 0.024 | VGGSEKY +dK_MMCCH-2 (K) | 634 |
| 46 | 1075 | 1080 | 544.7770 | 1087.5394 | 1087.5372 | 2.02 | C | 1 | 18 | 0.017 | QALQKY +dK_MMCCH-2 (K) | 1079 |
| 47 | 1212 | 1230 | 875.0860 | 2622.2389 | 2622.2424 | -1.33 | C | 4 | 17 | 0.02 | KYEITQQLHDLHVGDNF +dK_MMCCH-2 (K) | 1212 |
| 48 | 1298 | 1312 | 824.0828 | 2469.2266 | 2469.2324 | -2.31 | C | 2 | 19 | 0.012 | LQIQKEGIYENIAKF +2 dK_MMCCH-2 (K) | 1302, 1311 |
| 49 | 1298 | 1312 | 711.3739 | 2131.0999 | 2131.1023 | -1.17 | C | 2 | 36 | 0.00023 | LQIQKEGIYENIAKF +dK_MMCCH-2 (K) | 1311 |
| 50 | 1526 | 1536 | 851.3828 | 1700.7511 | 1700.7505 | 0.35 | C | 1 | 19 | 0.014 | KHNLPQDSFDY +dK_MMCCH-2 (K) | 1526 |
| 51 | 1589 | 1606 | 784.3549 | 2350.0428 | 2350.0392 | 1.53 | C | 0 | 23 | 0.0054 | ICVEQGGEQNCKTKAGSF +dK_MMCCH-2 (K) | 1602 |
| 52 | 1696 | 1702 | 607.3007 | 1212.5868 | 1212.5849 | 1.57 | C | 1 | 23 | 0.0045 | TTLEKHF +dK_MMCCH-2 (K) | 1700 |
| 53 | 1708 | 1719 | 839.8433 | 1677.6720 | 1677.6651 | 4.11 | C | 0 | 28 | 0.0015 | KNMQADDSPDGY +dK_MMCCH-2 (K) | 1708 |
| 54 | 1801 | 1809 | 706.8373 | 1411.6601 | 1411.6595 | 0.50 | C | 0 | 19 | 0.012 | SHKTFPNPF +dK_MMCCH-2 (K) | 1803 |
| 55 | 1985 | 1995 | 850.4278 | 1698.8410 | 1698.8399 | 0.65 | C | 0 | 32 | 0.00062 | IKQQQEADRVF +dK_MMCCH-2 (K) | 1986 |
| 56 | 2001 | 2011 | 726.8445 | 1451.6744 | 1451.6755 | -0.76 | C | 1 | 22 | 0.0059 | KGFGQSASVSF +dK_MMCCH-2 (K) | 2001 |
| 57 | 2424 | 2438 | 1032.4364 | 2062.8582 | 2062.8621 | -1.84 | C | 0 | 20 | 0.011 | ICKTADDCHASGMIF +dK_MMCCH-2 (K) | 2426 |
| 58 | 2455 | 2462 | 645.3273 | 1288.6401 | 1288.6373 | 2.17 | C | 1 | 19 | 0.013 | KYDITQAL +dK_MMCCH-2 (K) | 2455 |
| 59 | 2463 | 2479 | 752.3498 | 2254.0277 | 2254.0253 | 1.11 | C | 1 | 18 | 0.016 | KAQSHPEDVFDTDAPF +dK_MMCCH-2 (K) | 2463 |
| 60 | 2506 | 2532 | 761.6044 | 3042.3884 | 3042.3738 | 4.80 | C | 0 | 19 | 0.012 | SAGEGHTDDHGSDHIAGSGVRKDVTSL +dK_MMCCH-2 (K) | 2527 |
| 61 | 2754 | 2760 | 598.3299 | 1194.6452 | 1194.6471 | -1.51 | C | 1 | 18 | 0.017 | KQPLKPF +dK_MMCCH-2 (K) | 2754 |
| 62 | 2754 | 2760 | 598.3325 | 1194.6504 | 1194.6471 | 2.76 | C | 1 | 23 | 0.0046 | KQPLKPF +dK_MMCCH-2 (K) | 2758 |
| 63 | 2865 | 2872 | 673.3627 | 1344.7109 | 1344.7112 | -0.15 | C | 1 | 15 | 0.032 | RYDITKVL +dK_MMCCH-2 (K) | 2870 |
| 64 | 3235 | 3242 | 617.3137 | 1232.6129 | 1232.6111 | 1.46 | C | 0 | 22 | 0.0057 | TSANVKIY +dK_MMCCH-2 (K) | 3240 |

Figure 23 continued

| | | | | | | | | | | |
|---|---|---|---|---|---|---|---|---|---|---|
| 65 | 3399 | 3406 | 576.8025 | 1151.5904 | 1151.5896 | 0.69 | c | 3 | 24 | 0.0036 | IAGPTKDL+dK_MMCCH-2 (K) | 3404 |
| 66 | 181 | 191 | 853.3754 | 1704.7363 | 1704.7375 | -0.70 | Th | 3 | 58 | 1.50E-06 | LDALEQDEFCK+dK_MMCCH-2 (K) | 191 |
| 67 | 247 | 260 | 631.6194 | 1891.8363 | 1891.8305 | 3.07 | Th | 2 | 18 | 0.016 | LRGKDPNSADCAHN+dK_MMCCH-2 (K) | 250 |
| 68 | 283 | 293 | 782.8555 | 1563.6985 | 1563.7028 | -2.75 | Th | 3 | 31 | 0.00076 | AKPADSFDYGR+dK_MMCCH-2 (K) | 284 |
| 69 | 365 | 374 | 715.3283 | 1428.6421 | 1428.6418 | 0.21 | Th | 2 | 41 | 7.20E-05 | LGGPTEMKWG+dK_MMCCH-2 (K); Oxidation (M) | 372 |
| 70 | 431 | 437 | 569.2861 | 1136.5576 | 1136.5576 | 0.00 | Th | 1 | 13 | 0.047 | FDKPPVP+dK_MMCCH-2 (K) | 433 |
| 71 | 467 | 472 | 538.7416 | 1075.4687 | 1075.4644 | 4.00 | Th | 0 | 13 | 0.045 | FQNDKS+dK_MMCCH-2 (K) | 471 |
| 72 | 629 | 636 | 582.7663 | 1163.5180 | 1163.5169 | 1.03 | Th | 1 | 24 | 0.0037 | VGGSEKYS+dK_MMCCH-2 (K) | 634 |
| 73 | 893 | 904 | 904.8962 | 1807.7779 | 1807.7698 | 4.48 | Th | 1 | 18 | 0.018 | FHGEPKWCPSPE+dK_MMCCH-2 (K) | 898 |
| 74 | 1414 | 1419 | 564.7561 | 1127.4976 | 1127.4957 | 1.69 | Th | 1 | 21 | 0.0075 | LWDNKD+dK_MMCCH-2 (K) | 1418 |
| 75 | 1525 | 1539 | 738.3547 | 2212.0424 | 2212.0371 | 2.40 | Th | 3 | 43 | 5.10E-05 | LKHNLPQDSFDYQNR+dK_MMCCH-2 (K) | 1526 |
| 76 | 1589 | 1605 | 735.3312 | 2202.9719 | 2202.9708 | 0.50 | Th | 2 | 29 | 0.0012 | ICVEQGGEQNCKTKAGS+dK_MMCCH-2 (K) | 1600 |
| 77 | 1589 | 1605 | 735.3312 | 2202.9717 | 2202.9708 | 0.41 | Th | 2 | 34 | 0.0004 | ICVEQGGEQNCKTKAGS+dK_MMCCH-2 (K) | 1602 |
| 78 | 1800 | 1809 | 780.3710 | 1558.7274 | 1558.7279 | -0.32 | Th | 2 | 28 | 0.0017 | FSHKTFPNPF+dK_MMCCH-2 (K) | 1803 |
| 79 | 1952 | 1963 | 627.2840 | 1878.8302 | 1878.8247 | 2.93 | Th | 2 | 51 | 7.90E-06 | FSKPEDTFDYHR+dK_MMCCH-2 (K) | 1954 |
| 80 | 1985 | 1994 | 776.8959 | 1551.7772 | 1551.7715 | 3.67 | Th | 2 | 23 | 0.0045 | IKQQEADRV+dK_MMCCH-2 (K) | 1986 |
| 81 | 2193 | 2199 | 667.3011 | 1332.5876 | 1332.5849 | 2.03 | Th | 2 | 27 | 0.0019 | YWDWTKP+dK_MMCCH-2 (K) | 2198 |
| 82 | 2200 | 2206 | 562.3088 | 1122.6031 | 1122.5995 | 3.30 | Th | 2 | 22 | 0.0061 | ISKLPDL+dK_MMCCH-2 (K) | 2202 |
| 83 | 2225 | 2229 | 462.2199 | 922.4251 | 922.4259 | -0.76 | Th | 1 | 17 | 0.021 | FAKGY+dK_MMCCH-2 (K) | 2227 |
| 84 | 2359 | 2363 | 509.2324 | 1016.4503 | 1016.4460 | 4.33 | Th | 1 | 15 | 0.034 | FTKMH+dK_MMCCH-2 (K); Oxidation (M) | 2361 |
| 85 | 2941 | 2950 | 720.8391 | 1439.6635 | 1439.6602 | 2.29 | Th | 3 | 45 | 2.90E-05 | LDEANDLKNA+dK_MMCCH-2 (K) | 2948 |
| 86 | 3009 | 3015 | 573.2759 | 1144.5372 | 1144.5335 | 3.23 | Th | 0 | 15 | 0.033 | LKEHGSH+dK_MMCCH-2 (K) | 3010 |
| 87 | 3020 | 3026 | 662.2905 | 1322.5664 | 1322.5642 | 1.66 | Th | 2 | 20 | 0.0092 | YWDWTKS+dK_MMCCH-2 (K) | 3025 |

Figure 23 continued

| 88 | 3399 | 3405 | 520.2601 | 1038.5057 | 1038.5056 | 0.10 | Th | 1 | 20 | 0.011 | IAGPTKD+dK_MMCCH-2 (K) | 3404 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the lysine conjugation site for KLH1 or KLH2.

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 124 | 141 | 589.3095 | 2353.2089 | 2353.2001 | 3.74 | T | 1 | 37 | 0.00018 | GFTDPPVKHHQSANILVR +dK_MMCCH-2 (K) | 131 |
| 2 | 142 | 149 | 656.3412 | 1310.6678 | 1310.6653 | 1.98 | T | 1 | 35 | 0.00029 | KNINDLTR +dK_MMCCH-2 (K) | 142 |
| 3 | 157 | 166 | 822.8796 | 1643.7446 | 1643.7402 | 2.68 | T | 1 | 18 | 0.015 | EAFHKFQEDR +dK_MMCCH-2 (K) | 161 |
| 4 | 184 | 192 | 726.8427 | 1451.6707 | 1451.6649 | 4.00 | T | 1 | 22 | 0.0063 | CPRPDAKDR +dK_MMCCH-2 (K) | 190 |
| 5 | 377 | 402 | 833.4029 | 3329.5825 | 3329.5784 | 1.23 | T | 0 | 28 | 0.0016 | AHCAISLEHMHLKPFAFSSPLNNNEK +dK_MMCCH-2 (K) | 389 |
| 6 | 460 | 477 | 781.3949 | 2341.1629 | 2341.1624 | 0.21 | T | 1 | 22 | 0.0068 | TSANVDFIKTTDSVQHK +dK_MMCCH-2 (K) | 469 |
| 7 | 470 | 488 | 748.0465 | 2241.1177 | 2241.1100 | 3.44 | T | 1 | 43 | 5.20E-05 | TTDSVQHKAGTFAVLGGSK +dK_MMCCH-2 (K) | 477 |
| 8 | 553 | 560 | 663.8680 | 1325.7214 | 1325.7166 | 3.62 | T | 2 | 21 | 0.0073 | VKFDKVPR +dK_MMCCH-2 (K) | 554 |
| 9 | 566 | 570 | 485.2456 | 968.4767 | 968.4749 | 1.86 | T | 1 | 17 | 0.018 | KNVDR +dK_MMCCH-2 (K) | 566 |
| 10 | 581 | 587 | 547.8373 | 1093.6601 | 1093.6569 | 2.93 | T | 1 | 22 | 0.006 | KALALLK +dK_MMCCH-2 (K) | 581 |
| 11 | 588 | 606 | 781.0351 | 2340.0835 | 2340.0845 | -0.43 | T | 1 | 30 | 0.001 | EDKSAGGFQQLGAFHGEPK +dK_MMCCH-2 (K) | 590 |
| 12 | 591 | 615 | 753.6043 | 3010.3881 | 3010.3742 | 4.62 | T | 1 | 19 | 0.012 | SAGGFQQLGAFHGEPKWCPSPEASK +dK_MMCCH-2 (K) | 606 |
| 13 | 645 | 681 | 1158.5398 | 4630.1301 | 4630.1063 | 5.12 | T | 1 | 27 | 0.0018 | HGYDGALPYWDWTSPLNHLPELADHEKYVDPEDGVEK +dK_MMCCH-2 (K) | 671 |
| 14 | 682 | 699 | 620.2947 | 2477.1496 | 2477.1434 | 2.50 | T | 1 | 21 | 0.0082 | HNPWFDGHIDTVQKTTTR +dK_MMCCH-2 (K) | 695 |
| 15 | 700 | 719 | 887.7702 | 2660.2888 | 2660.2945 | -2.14 | T | 1 | 39 | 0.00013 | SVQNKLFEQPEFGHYTSIAK +dK_MMCCH-2 (K) | 704 |
| 16 | 790 | 804 | 669.3174 | 2004.9305 | 2004.9220 | 4.24 | T | 0 | 38 | 0.00017 | GKPYNVANCAVTSMR +dK_MMCCH-2 (K) | 791 |
| 17 | 858 | 863 | 520.2993 | 1038.5840 | 1038.5783 | 5.39 | T | 1 | 23 | 0.0051 | KLEAIK +dK_MMCCH-2 (K) | 858 |
| 18 | 953 | 965 | 635.3319 | 1902.9737 | 1902.9662 | 3.94 | T | 1 | 53 | 4.80E-06 | DLFKQPSVIHEPR +dK_MMCCH-2 (K) | 956 |

| | | | | | | | | | |
|---|---|---|---|---|---|---|---|---|---|
| 19 | 986 | 1000 | 1027.0366 | 2052.0587 | 2052.0561 | 1.27 | T | 1 | 75 | 2.90E-08 | KNIENLSLGELESLR +dK_MMCCH-2 (K) | 986 |
| 20 | 1048 | 1060 | 609.3551 | 1825.0435 | 1825.0423 | 0.66 | T | 1 | 44 | 3.80E-05 | LYVVVENALLKK +dK_MMCCH-2 (K) | 1060 |
| 21 | 1092 | 1114 | 791.8734 | 3163.4645 | 3163.4682 | -1.17 | T | 1 | 28 | 0.0018 | QHHYETNPFHHGKITHENEITTR +dK_MMCCH-2 (K) | 1104 |
| 22 | 1199 | 1203 | 353.1914 | 1056.5522 | 1056.5538 | -1.51 | T | 1 | 17 | 0.018 | KRPYR +dK_MMCCH-2 (K) | 1199 |
| 23 | 1331 | 1338 | 620.3551 | 1238.6956 | 1238.6944 | 0.97 | T | 1 | 17 | 0.018 | LDITKALK +dK_MMCCH-2 (K) | 1335 |
| 24 | 1395 | 1402 | 649.8379 | 1297.6612 | 1297.6588 | 1.85 | T | 1 | 26 | 0.0022 | KDITQLDK +dK_MMCCH-2 (K) | 1395 |
| 25 | 1395 | 1403 | 485.5953 | 1453.7639 | 1453.7599 | 2.75 | T | 2 | 16 | 0.025 | KDITQLDKR +dK_MMCCH-2 (K) | 1402 |
| 26 | 1417 | 1445 | 844.1611 | 3372.6154 | 3372.6020 | 4.00 | T | 1 | 19 | 0.012 | ADHSSDGFQAIASFHALPPLCPSPAASKR +dK_MMCCH-2 (K) | 1444 |
| 27 | 1473 | 1489 | 778.4021 | 2332.1845 | 2332.1827 | 0.77 | T | 1 | 47 | 1.90E-05 | KHGAVVGLPVWDWTLPR +dK_MMCCH-2 (K) | 1473 |
| 28 | 1721 | 1746 | 1092.8043 | 3275.3911 | 3275.3886 | 0.76 | T | 1 | 14 | 0.044 | TAGDCEDAGYFTVLGGEKEMPWAFDR +dK_MMCCH-2 (K); Oxidation (M) | 1738 |
| 29 | 1890 | 1922 | 879.8327 | 4394.1271 | 4394.1048 | 5.07 | T | 1 | 16 | 0.024 | HGSSVAVPVWDWTKPIHNIPHLFTDKEYYDVWR +dK_MMCCH-2 (K) | 1915 |
| 30 | 1923 | 1932 | 756.3803 | 1510.7461 | 1510.7425 | 2.38 | T | 1 | 26 | 0.0028 | NKVMPNPFAR +dK_MMCCH-2 (K) | 1924 |
| 31 | 2067 | 2076 | 746.8841 | 1491.7536 | 1491.7544 | -0.54 | T | 1 | 28 | 0.0014 | KHAVPNDVFK +dK_MMCCH-2 (K) | 2067 |
| 32 | 2121 | 2149 | 890.4184 | 3557.6444 | 3557.6378 | 1.86 | T | 1 | 29 | 0.0013 | TSADVQFQICKTSEDCHHGGQIFVLGGTK +dK_MMCCH-2 (K) | 2131 |
| 33 | 2359 | 2367 | 736.8409 | 1471.6672 | 1471.6653 | 1.29 | T | 1 | 19 | 0.012 | DKLFNDPER +Deamidated (NQ); dK_MMCCH-2 (K) | 2360 |
| 34 | 2461 | 2490 | 642.8212 | 3850.8834 | 3850.8638 | 5.09 | T | 0 | 17 | 0.02 | RPLRPFSDPINHNAFTHSNAKPTDVFEYSR +dK_MMCCH-2 (K) | 2481 |
| 35 | 2507 | 2514 | 682.3522 | 1362.6898 | 1362.6853 | 3.30 | T | 1 | 40 | 9.90E-05 | KLEHELEK +dK_MMCCH-2 (K) | 2507 |
| 36 | 2515 | 2520 | 571.7623 | 1141.5100 | 1141.5074 | 2.28 | T | 1 | 19 | 0.013 | QKEEDR +dK_MMCCH-2 (K) | 2516 |
| 37 | 2595 | 2609 | 983.5305 | 1965.0465 | 1965.0493 | -1.42 | T | 1 | 20 | 0.01 | IIDTSGKQLPSDLIK +dK_MMCCH-2 (K) | 2601 |
| 38 | 2621 | 2636 | 802.7087 | 2405.1044 | 2405.1083 | -1.62 | T | 1 | 48 | 1.50E-05 | HHEKHHEDHHEDILVR +dK_MMCCH-2 (K) | 2624 |
| 39 | 2637 | 2651 | 1069.5308 | 2137.0470 | 2137.0374 | 4.45 | T | 1 | 61 | 8.10E-07 | KNIHSLSHHEAEELR +dK_MMCCH-2 (K) | 2637 |
| 40 | 2652 | 2682 | 975.1997 | 3896.7695 | 3896.7563 | 3.39 | T | 1 | 19 | 0.012 | DALYKLQNDESHGGYEHIAGFHGYPNLCPEK +dK_MMCCH-2 (K) | 2656 |
| 41 | 2657 | 2686 | 934.9150 | 3735.6311 | 3735.6358 | -1.28 | T | 1 | 22 | 0.0068 | LQNDESHGGYEHIAGFHGYPNLCPEKGDEK +dK_MMCCH-2 (K) | 2682 |

Figure 24 continued

| # | | | | | | | | | | |
|---|---|---|---|---|---|---|---|---|---|---|
| 42 | 2657 | 2686 | 1246.2205 | 3735.6396 | 3735.6358 | 0.99 | T | 1 | 24 | 0.0036 | LQNDESHGGYEHIAGFHGYPNLCPEKGDEK +dK_MMCCH-2 (K) | 2686 |
| 43 | 2714 | 2748 | 1087.7703 | 4347.0519 | 4347.0524 | -0.12 | T | 1 | 32 | 0.00056 | KHGSHLGIPYWDWTQTISSLPTFFADSGNNNPFFK +dK_MMCCH-2 (K) | 2714 |
| 44 | 2851 | 2883 | 1009.2175 | 4032.8410 | 4032.8346 | 1.59 | T | 0 | 60 | 1.10E-06 | VKPAHAGSCAGDIMHVPLHPFNYESVNNDDFTR +dK_MMCCH-2 (K) | 2852 |
| 45 | 2897 | 2919 | 800.1419 | 3196.5385 | 3196.5287 | 3.07 | T | 1 | 66 | 2.30E-07 | FNYKYDNLNLHGHNIEELEEVLR +dK_MMCCH-2 (K) | 2900 |
| 46 | 2938 | 2947 | 730.4152 | 1458.8158 | 1458.8156 | 0.07 | T | 1 | 35 | 0.00028 | TTAVVKVYIK +dK_MMCCH-2 (K) | 2943 |
| 47 | 3003 | 3021 | 825.7608 | 2474.2877 | 2474.2879 | -0.08 | T | 1 | 62 | 7.00E-07 | KYDHTELDASVLPAPIIVR +dK_MMCCH-2 (K) | 3003 |
| 48 | 3022 | 3044 | 966.5270 | 2896.5593 | 2896.5521 | 2.49 | T | 1 | 15 | 0.03 | RPNNAVFDIIEIPIGKDVNLPPK +dK_MMCCH-2 (K) | 3037 |
| 49 | 123 | 151 | 616.6582 | 3693.9058 | 3693.9049 | 0.24 | G | 2 | 27 | 0.0018 | KGFTDPPVKHHQSANLLVRKNINDLTREE +dK_MMCCH-2 (K) | 123 |
| 50 | 123 | 151 | 739.7917 | 3693.9221 | 3693.9049 | 4.63 | G | 2 | 22 | 0.006 | KGFTDPPVKHHQSANLLVRKNINDLTREE +dK_MMCCH-2 (K) | 131 |
| 51 | 158 | 176 | 846.3843 | 2536.1310 | 2536.1329 | -0.75 | G | 3 | 20 | 0.011 | AFHKFQEDRSVDGYQATAE +dK_MMCCH-2 (K) | 161 |
| 52 | 526 | 544 | 777.7485 | 2330.2236 | 2330.2304 | -2.92 | G | 1 | 22 | 0.0068 | VDGTKLASSLIPHASVIRE +dK_MMCCH-2 (K) | 530 |
| 53 | 589 | 612 | 1102.8267 | 3305.4582 | 3305.4621 | -1.18 | G | 1 | 15 | 0.029 | DKSAGGFQQLGAFHGEPKWCPSPE +2 dK_MMCCH-2 (K) | 590, 606 |
| 54 | 825 | 841 | 820.3707 | 2458.0902 | 2458.0940 | -1.55 | G | 1 | 24 | 0.004 | HSVPFNVFDYKTNFNYE +dK_MMCCH-2 (K) | 835 |
| 55 | 847 | 860 | 644.0053 | 1928.9941 | 1928.9917 | 1.24 | G | 0 | 17 | 0.019 | FNGLSISQLNKKLE +Deamidated (NQ); dK_MMCCH-2 (K) | 858 |
| 56 | 942 | 972 | 764.6007 | 3817.9672 | 3817.9614 | 1.52 | G | 3 | 17 | 0.021 | VFDLKPASLGKDLFKQPSVIHEPRIGHHEGE +dK_MMCCH-2 (K) | 946 |
| 57 | 942 | 970 | 908.9828 | 3631.9022 | 3631.8973 | 1.35 | G | 2 | 25 | 0.003 | VFDLKPASLGKDLFKQPSVIHEPRIGHHE +dK_MMCCH-2 (K) | 956 |
| 58 | 1397 | 1413 | 774.4363 | 2320.2872 | 2320.2824 | 2.07 | G | 1 | 16 | 0.024 | ITQLDKRQQLSLVKALE +dK_MMCCH-2 (K) | 1410 |
| 59 | 1495 | 1522 | 866.6916 | 3462.7373 | 3462.7381 | -0.26 | G | 3 | 16 | 0.023 | LLTVSTIHDPETGRDIPNPFIGSKIEFE +dK_MMCCH-2 (K) | 1518 |
| 60 | 1755 | 1765 | 570.6053 | 1708.7940 | 1708.7913 | 1.64 | G | 2 | 18 | 0.016 | TLDKMNLRHDE +dK_MMCCH-2 (K) | 1758 |
| 61 | 2089 | 2100 | 854.4076 | 1706.8006 | 1706.8008 | -0.06 | G | 2 | 21 | 0.0077 | IGGMNLHEIEKE +dK_MMCCH-2 (K) | 2099 |
| 62 | 2647 | 2661 | 715.6776 | 2144.0108 | 2144.0095 | 0.61 | G | 4 | 29 | 0.0013 | AEELRDALYKLQNDE +dK_MMCCH-2 (K) | 2656 |
| 63 | 3090 | 3097 | 632.8022 | 1263.5898 | 1263.5879 | 1.50 | G | 0 | 14 | 0.04 | LGKMYSVE +dK_MMCCH-2 (K) | 3092 |
| 64 | 59 | 68 | 729.3448 | 1456.6750 | 1456.6731 | 1.37 | C | 1 | 19 | 0.012 | VLGGPSEMKW +dK_MMCCH-2 (K); Oxidation (M) | 67 |

Figure 24 continued

| | | | | | | | | | |
|---|---|---|---|---|---|---|---|---|---|
| 65 | 94 | 100 | 573.2989 | 1144.5833 | 1144.5838 | -0.44 | C | 1 | 23 | 0.0048 | TVKAELF +dK_MMCCH-2 (K) | 96 |
| 66 | 140 | 159 | 692.6202 | 2766.4519 | 2766.4486 | 1.16 | C | 3 | 28 | 0.0018 | VRKNINDLTREEVLNLREAF +dK_MMCCH-2 (K) | 142 |
| 67 | 160 | 171 | 606.9435 | 1817.8086 | 1817.8043 | 2.37 | C | 1 | 19 | 0.012 | HKFQEDRSVDGY +dK_MMCCH-2 (K) | 161 |
| 68 | 429 | 450 | 990.8075 | 2969.4007 | 2969.3899 | 3.64 | C | 1 | 36 | 0.00024 | GGISLENIEKMIHENQEDRIY +dK_MMCCH-2 (K); Oxidation (M) | 438 |
| 69 | 584 | 595 | 787.4017 | 1572.7888 | 1572.7858 | 1.91 | C | 2 | 42 | 6.40E-05 | ALLKEDKSAGGF +dK_MMCCH-2 (K) | 590 |
| 70 | 715 | 723 | 655.8735 | 1309.7325 | 1309.7316 | 0.76 | C | 1 | 26 | 0.0023 | TSIAKQVLL +dK_MMCCH-2 (K) | 719 |
| 71 | 783 | 788 | 544.7770 | 1087.5395 | 1087.5372 | 2.11 | C | 1 | 26 | 0.0024 | QALQKY +dK_MMCCH-2 (K) | 787 |
| 72 | 944 | 955 | 821.4324 | 1640.8503 | 1640.8484 | 1.16 | C | 3 | 25 | 0.0034 | DLKPASLGKDLF +dK_MMCCH-2 (K) | 946 |
| 73 | 1013 | 1018 | 516.7581 | 1031.5017 | 1031.4998 | 1.84 | C | 0 | 13 | 0.049 | ESIAKF +dK_MMCCH-2 (K) | 1017 |
| 74 | 1330 | 1337 | 620.3546 | 1238.6947 | 1238.6944 | 0.16 | C | 1 | 21 | 0.0089 | KLDITKAL +dK_MMCCH-2 (K) | 1335 |
| 75 | 1580 | 1586 | 544.2614 | 1086.5083 | 1086.5056 | 2.49 | C | 0 | 13 | 0.049 | VGGKEPY +dK_MMCCH-2 (K) | 1583 |
| 76 | 1649 | 1664 | 1127.9900 | 2253.9654 | 2253.9637 | 0.75 | C | 2 | 18 | 0.014 | NLNDHTHDFSKPEDTF +dK_MMCCH-2 (K) | 1659 |
| 77 | 1649 | 1669 | 979.4319 | 2935.2738 | 2935.2759 | -0.72 | C | 4 | 24 | 0.0036 | NLNDHTHDFSKPEDTFDYQKF +dK_MMCCH-2 (K) | 1668 |
| 78 | 1732 | 1742 | 792.8744 | 1583.7342 | 1583.7364 | -1.39 | C | 1 | 17 | 0.02 | TVLGGEKEMPW +dK_MMCCH-2 (K) | 1738 |
| 79 | 1818 | 1827 | 753.3699 | 1504.7253 | 1504.7232 | 1.40 | C | 1 | 18 | 0.018 | SERDIGSLKY +dK_MMCCH-2 (K) | 1826 |
| 80 | 2076 | 2082 | 612.3045 | 1222.5944 | 1222.5944 | 0.08 | C | 3 | 14 | 0.037 | KYELLGY +dK_MMCCH-2 (K) | 2076 |
| 81 | 2160 | 2184 | 1085.5143 | 3253.5210 | 3253.5179 | 0.95 | C | 3 | 21 | 0.0089 | KYDITHALHDAHITPEDVFHPSEPF +dK_MMCCH-2 (K) | 2150 |
| 82 | 2476 | 2488 | 923.9219 | 1845.8293 | 1845.8244 | 2.71 | C | 1 | 25 | 0.0029 | THSNAKPTDVFEY +dK_MMCCH-2 (K) | 2481 |
| 83 | 2656 | 2672 | 747.3428 | 2239.0067 | 2239.0004 | 2.81 | C | 2 | 30 | 0.00098 | KLQNDESHGGYEHIAGF +dK_MMCCH-2 (K) | 2656 |
| 84 | 2738 | 2749 | 856.3768 | 1710.7390 | 1710.7348 | 2.46 | C | 2 | 24 | 0.004 | ADSGNNNPFFKY +dK_MMCCH-2 (K) | 2748 |
| 85 | 2946 | 2960 | 965.4055 | 1928.7964 | 1928.7986 | -1.14 | C | 1 | 40 | 9.10E-05 | IKSGTDSDDEYAGSF +dK_MMCCH-2 (K) | 2947 |
| 86 | 2961 | 2971 | 769.8918 | 1537.7691 | 1537.7673 | 1.24 | C | 1 | 21 | 0.0078 | VILGGAKEMPW +dK_MMCCH-2 (K) | 2967 |
| 87 | 1 | 9 | 733.3348 | 1464.6550 | 1464.6516 | 2.32 | Th | 2 | 17 | 0.021 | MTPEELKTY +dK_MMCCH-2 (K); Oxidation (M) | 7 |

Figure 24 continued

| | | | | | | | | | |
|---|---|---|---|---|---|---|---|---|---|
| 88 | 38 | 56 | 861.6805 | 2582.0198 | 2582.0108 | 3.49 | Th | 2 | 15 | 0.033 | VCIPDDNDRNDDHCEKAGD +dK_MMCCH-2 (K) | 53 |
| 89 | 59 | 69 | 785.3774 | 1568.7402 | 1568.7367 | 2.23 | Th | 3 | 61 | 7.10E-07 | VLGGPSEMKWQ +dK_MMCCH-2 (K) | 67 |
| 90 | 78 | 84 | 569.2872 | 1136.5599 | 1136.5536 | 5.54 | Th | 1 | 49 | 1.10E-05 | LSDTVHK +dK_MMCCH-2 (K) | 84 |
| 91 | 116 | 124 | 670.3482 | 1338.6819 | 1338.6755 | 4.78 | Th | 2 | 27 | 0.002 | VVVHHPEKG +dK_MMCCH-2 (K) | 123 |
| 92 | 125 | 135 | 815.8878 | 1629.7611 | 1629.7610 | 0.06 | Th | 1 | 14 | 0.044 | FTDPPVKHHQS +dK_MMCCH-2 (K) | 131 |
| 93 | 431 | 439 | 707.8528 | 1413.6911 | 1413.6883 | 1.98 | Th | 3 | 39 | 0.00013 | ISLENIEKM +dK_MMCCH-2 (K) | 438 |
| 94 | 521 | 530 | 707.8450 | 1413.6754 | 1413.6698 | 3.96 | Th | 2 | 74 | 4.30E-08 | VDITEVDGTK +dK_MMCCH-2 (K) | 530 |
| 95 | 585 | 591 | 585.8101 | 1169.6057 | 1169.6002 | 4.70 | Th | 1 | 35 | 0.00034 | LLKEDKS +dK_MMCCH-2 (K) | 590 |
| 96 | 601 | 612 | 904.8956 | 1807.7767 | 1807.7698 | 3.82 | Th | 1 | 25 | 0.0035 | FHGEPKWCPSPE +dK_MMCCH-2 (K) | 606 |
| 97 | 666 | 672 | 607.2832 | 1212.5518 | 1212.5485 | 2.80 | Th | 2 | 23 | 0.0046 | LADHEKY +dK_MMCCH-2 (K) | 671 |
| 98 | 821 | 828 | 617.8120 | 1233.6095 | 1233.6064 | 2.51 | Th | 1 | 19 | 0.012 | VTKEHSVP +dK_MMCCH-2 (K) | 823 |
| 99 | 831 | 837 | 612.7877 | 1223.5608 | 1223.5533 | 6.13 | Th | 2 | 25 | 0.003 | VFDYKTN +dK_MMCCH-2 (K) | 835 |
| 100 | 1064 | 1074 | 586.9629 | 1757.8668 | 1757.8600 | 3.93 | Th | 5 | 15 | 0.032 | VAVPYWDWTKR +dK_MMCCH-2 (K) | 1073 |
| 101 | 1156 | 1164 | 630.8397 | 1259.6648 | 1259.6584 | 5.08 | Th | 2 | 22 | 0.0058 | LLGGKGKYS +dK_MMCCH-2 (K) | 1162 |
| 102 | 1219 | 1232 | 980.4239 | 1958.8332 | 1958.8316 | 0.82 | Th | 1 | 53 | 4.70E-06 | FDKSDNNDEATKTH +dK_MMCCH-2 (K) | 1230 |
| 103 | 1579 | 1587 | 665.8146 | 1329.6146 | 1329.6064 | 6.17 | Th | 2 | 19 | 0.012 | WVGGKEPYG +dK_MMCCH-2 (K) | 1583 |
| 104 | 1657 | 1668 | 921.9210 | 1841.8275 | 1841.8182 | 5.05 | Th | 2 | 42 | 6.10E-05 | FSKPEDTFDYQK +dK_MMCCH-2 (K) | 1659 |
| 105 | 1657 | 1668 | 921.9207 | 1841.8269 | 1841.8182 | 4.72 | Th | 2 | 50 | 9.90E-06 | FSKPEDTFDYQK +dK_MMCCH-2 (K) | 1668 |
| 106 | 1733 | 1741 | 664.3254 | 1326.6362 | 1326.6312 | 3.77 | Th | 2 | 17 | 0.022 | VLGGEKEMP +dK_MMCCH-1 (K); Oxidation (M) | 1738 |
| 107 | 1756 | 1760 | 479.7249 | 957.4353 | 957.4300 | 5.64 | Th | 1 | 13 | 0.049 | LDKMN +dK_MMCCH-2 (K) | 1758 |
| 108 | 1894 | 1904 | 850.4138 | 1698.8131 | 1698.8116 | 0.88 | Th | 5 | 29 | 0.0013 | VAVPYWDWTKP +dK_MMCCH-2 (K) | 1903 |
| 109 | 2094 | 2100 | 618.3031 | 1234.5916 | 1234.5903 | 1.05 | Th | 1 | 26 | 0.0024 | LHEIEKE +dK_MMCCH-2 (K) | 2099 |
| 110 | 2129 | 2141 | 933.8805 | 1865.7465 | 1865.7495 | -1.61 | Th | 0 | 27 | 0.0019 | ICKTSEDCHGGQ +dK_MMCCH-2 (K) | 2131 |

Figure 24 continued

| 111 | 2238 | 2249 | 814.3991 | 1626.7837 | 1626.7811 | 1.60 | Th | 4 | 49 | 1.30E-05 | LTTAEVDNLKDA +dK_MMCCH-2 (K) | 2247 |
| --- | --- | --- | --- | --- | --- | --- | --- | --- | --- | --- | --- | --- |
| 112 | 2475 | 2484 | 728.3341 | 1454.6535 | 1454.6500 | 2.41 | Th | 1 | 27 | 0.002 | FTHSNAKPTD +dK_MMCCH-2 (K) | 2481 |
| 113 | 2512 | 2521 | 538.6010 | 1612.7810 | 1612.7766 | 2.73 | Th | 0 | 33 | 0.00055 | LEKQKEEDRT +dK_MMCCH-2 (K) | 2514 |
| 114 | 2595 | 2607 | 862.9463 | 1723.8780 | 1723.8702 | 4.52 | Th | 3 | 30 | 0.0011 | IIDTSGKQLPSDL +dK_MMCCH-2 (K) | 2601 |
| 115 | 2607 | 2612 | 520.7814 | 1039.5483 | 1039.5446 | 3.56 | Th | 2 | 23 | 0.0056 | LIKMPT +dK_MMCCH-2 (K) | 2609 |
| 116 | 2766 | 2771 | 551.7883 | 1101.5621 | 1101.5529 | 8.35 | Th | 1 | 24 | 0.0041 | IFQQTK +dK_MMCCH-2 (K) | 2771 |
| 117 | 2808 | 2816 | 638.3212 | 1274.6279 | 1274.6217 | 4.94 | Th | 3 | 27 | 0.0019 | LIGGAEKYS +dK_MMCCH-2 (K) | 2814 |
| 118 | 2946 | 2960 | 965.4112 | 1928.8078 | 1928.7986 | 4.77 | Th | 3 | 54 | 3.80E-06 | IKSGTDSDDEYAGSF +dK_MMCCH-2 (K) | 2947 |
| 119 | 2961 | 2970 | 691.8644 | 1381.7142 | 1381.7098 | 3.18 | Th | 4 | 19 | 0.011 | VILGGAKEMP +dK_MMCCH-1 (K); Oxidation (M) | 2967 |
| 120 | 2990 | 2996 | 583.2855 | 1164.5565 | 1164.5485 | 6.87 | Th | 1 | 38 | 0.00015 | LTDDHVK +dK_MMCCH-2 (K) | 2996 |

Figure 24 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1043.0231 | 2084.0316 | 2084.0347 | -1.49 | T | 1 | 50 | 1.10E-05 | KNVDSLSSDEVLALEK +dK_MMCCH-2 (K) | 26 |
| 2 | 147 | 155 | 694.3697 | 1386.7249 | 1386.7217 | 2.31 | T | 1 | 47 | 2.20E-05 | ADITFLNKK +dK_MMCCH-2 (K) | 155 |
| 3 | 164 | 175 | 596.3073 | 1785.9001 | 1785.8985 | 0.90 | T | 1 | 36 | 0.00025 | LFEKVQPGHHTR +dK_MMCCH-2 (K) | 167 |
| 4 | 249 | 271 | 740.8343 | 2959.3081 | 2959.3051 | 0.98 | T | 1 | 25 | 0.0035 | GKDPNSADCAHNLIHTPMEPFDR +dK_MMCCH-2 (K) | 250 |
| 5 | 281 | 293 | 610.9426 | 1829.8061 | 1829.8043 | 0.98 | T | 1 | 50 | 1.00E-05 | EHAKPADSFDYGR +dK_MMCCH-2 (K) | 284 |
| 6 | 359 | 377 | 844.0674 | 2529.1803 | 2529.1861 | -2.29 | T | 1 | 17 | 0.02 | AGDFFLLGGPTEMKWGFYR +dK_MMCCH-2 (K) | 372 |
| 7 | 419 | 446 | 677.3699 | 3381.8133 | 3381.8132 | 0.03 | T | 1 | 56 | 2.50E-06 | QPTLVHRPAKGHFDKPPVPVAQANLAVR +Deamidated (NQ); dK_MMCCH-2 (K) | 428 |
| 8 | 429 | 446 | 752.0684 | 2253.1833 | 2253.1729 | 4.62 | T | 0 | 56 | 2.50E-06 | GHFDKPPVPVAQANLAVR +dK_MMCCH-2 (K) | 433 |
| 9 | 467 | 488 | 944.4542 | 2830.3408 | 2830.3385 | 0.85 | T | 1 | 66 | 2.80E-07 | FQNDKSVDGYQATVEFHALPAR +dK_MMCCH-2 (K) | 471 |
| 10 | 489 | 497 | 726.8427 | 1451.6707 | 1451.6649 | 4.00 | T | 1 | 22 | 0.0063 | CPRPDAKDR +dK_MMCCH-2 (K) | 495 |
| 11 | 936 | 950 | 720.3431 | 2158.0074 | 2158.0095 | -0.97 | T | 1 | 28 | 0.0016 | KHGFTGGLPYWDWTR +dK_MMCCH-2 (K) | 936 |
| 12 | 1082 | 1096 | 996.4633 | 1990.9120 | 1990.9063 | 2.86 | T | 0 | 22 | 0.006 | GKPVNTANCAIASMR +dK_MMCCH-2 (K) | 1083 |
| 13 | 1097 | 1115 | 827.0760 | 2478.2061 | 2478.2101 | -1.57 | T | 0 | 78 | 1.60E-08 | KPLQPFGLDSVINPDDETR +dK_MMCCH-2 (K) | 1097 |
| 14 | 1123 | 1149 | 1190.5605 | 3568.6598 | 3568.6497 | 2.86 | T | 1 | 75 | 3.00E-08 | VFDYKNNFDYEYESLAFNGLSJACQLDR +dK_MMCCH-2 (K) | 1127 |
| 15 | 1295 | 1311 | 764.0679 | 2289.1818 | 2289.1715 | 4.50 | T | 1 | 17 | 0.018 | SAFLQIOKEGIYENIAK +dK_MMCCH-2 (K) | 1302 |
| 16 | 1355 | 1385 | 1271.2678 | 3810.7816 | 3810.7876 | -1.55 | T | 1 | 52 | 6.40E-06 | GSAVAPVYWDWTEKADSLPSLINDATYFNSR +dK_MMCCH-2 (K) | 1368 |
| 17 | 1409 | 1450 | 1097.7150 | 5483.5388 | 5483.5213 | 3.19 | T | 1 | 18 | 0.016 | DPQPELWDNKDFYENVMLALEQDNFCDFEIQLELIHNALHSR +dK_MMCCH-2 (K) | 1418 |
| 18 | 1455 | 1480 | 838.6584 | 3350.6045 | 3350.6070 | -0.78 | T | 1 | 56 | 2.70E-06 | AKYSLSLDYTAFDPVFLHHANVDR +dK_MMCCH-2 (K) | 1456 |

Figure 24 continued

|    |      |      |           |           |       |   |   |         |                                                              |      |
|----|------|------|-----------|-----------|-------|---|---|---------|--------------------------------------------------------------|------|
| 19 | 1493 | 1507 | 721.6590  | 2161.9552 | 2161.9594 | -1.99 | T | 1 | 50 | 1.00E-05 | KKPYNEADCAVNEMR +dK_MMCCH-2 (K) | 1494 |
| 20 | 1508 | 1539 | 1032.2455 | 4124.9528 | 4124.9360 | 4.07 | T | 1 | 28 | 0.0014 | KPLQPFNPELNSDSMTLKHNLPQDSFDYQNR +dK_MMCCH-2 (K) | 1526 |
| 21 | 1542 | 1564 | 1070.1910 | 3207.5513 | 3207.5448 | 2.03 | T | 1 | 47 | 1.80E-05 | YQYDNLQFNHFSIQKLDQTIQAR +dK_MMCCH-2 (K) | 1556 |
| 22 | 1757 | 1768 | 612.9789  | 1835.9148 | 1835.9128 | 1.09 | T | 1 | 22 | 0.0057 | LYTVQFEDSLKR +dK_MMCCH-2 (K) | 1767 |
| 23 | 1949 | 1963 | 560.2522  | 2236.9797 | 2236.9735 | 2.77 | T | 0 | 57 | 2.00E-06 | TQEFSKPEDTFDYHR +dK_MMCCH-2 (K) | 1954 |
| 24 | 2045 | 2052 | 660.3506  | 1318.6867 | 1318.6843 | 1.90 | T | 1 | 15 | 0.035 | YDITKTLK +dK_MMCCH-2 (K) | 2052 |
| 25 | 2058 | 2069 | 909.4624  | 1816.9102 | 1816.9070 | 1.82 | T | 1 | 24 | 0.0043 | YDDTFTIKVHIK +dK_MMCCH-2 (K) | 2065 |
| 26 | 2228 | 2239 | 870.4213  | 1738.8280 | 1738.8236 | 2.53 | T | 1 | 19 | 0.012 | GYIKSEDAYTVR +dK_MMCCH-2 (K) | 2231 |
| 27 | 2527 | 2541 | 1007.5135 | 2013.0124 | 2013.0088 | 1.79 | T | 1 | 50 | 9.00E-06 | KDVTSLTASEIENLR +dK_MMCCH-2 (K) | 2527 |
| 28 | 2755 | 2764 | 764.3831  | 1526.7517 | 1526.7439 | 5.11 | T | 0 | 19 | 0.013 | QPLKPFSESR +Deamidated (NQ); dK_MMCCH-2 (K) | 2758 |
| 29 | 2866 | 2873 | 659.3611  | 1316.7076 | 1316.7050 | 1.97 | T | 1 | 13 | 0.05 | YDITKVLK +dK_MMCCH-2 (K) | 2870 |
| 30 | 3148 | 3155 | 629.3355  | 1256.6565 | 1256.6587 | -1.75 | T | 1 | 18 | 0.016 | KKPYNAAK +dK_MMCCH-2 (K) | 3149 |
| 31 | 433  | 456  | 975.8590  | 2924.5552 | 2924.5429 | 4.21 | G | 2 | 27 | 0.0019 | KPPVPVAQANLAVRKNINDLTAEE +dK_MMCCH-2 (K) | 433 |
| 32 | 466  | 481  | 1098.4963 | 2194.9781 | 2194.9841 | -2.73 | G | 2 | 31 | 0.00082 | RFQNDKSVDGYQATVE +Deamidated (NQ); dK_MMCCH-2 (K) | 471 |
| 33 | 1215 | 1235 | 721.6063  | 2882.3959 | 2882.3949 | 0.35 | G | 3 | 28 | 0.0016 | ITQQLHDLDLHVGDNFFLKYE +dK_MMCCH-2 (K) | 1233 |
| 34 | 1292 | 1303 | 879.4652  | 1756.9159 | 1756.9182 | -1.31 | G | 3 | 42 | 6.80E-05 | SIRSAFLQIQKE +dK_MMCCH-2 (K) | 1302 |
| 35 | 1308 | 1320 | 603.6326  | 1807.8761 | 1807.8749 | 0.61 | G | 0 | 20 | 0.01 | NIAKFHGKPGLCE +dK_MMCCH-2 (K) | 1315 |
| 36 | 1403 | 1422 | 921.4208  | 2761.2407 | 2761.2330 | 2.79 | G | 3 | 15 | 0.03 | NAVTSRDPQPELWDNKDFYE +dK_MMCCH-2 (K) | 1418 |
| 37 | 1952 | 1967 | 792.6837  | 2375.0293 | 2375.0205 | 3.71 | G | 3 | 19 | 0.014 | FSKPEDTFDYHRFGYE +dK_MMCCH-2 (K) | 1954 |
| 38 | 2477 | 2484 | 644.8373  | 1287.6600 | 1287.6573 | 2.10 | G | 0 | 22 | 0.0068 | APFFIKVE +dK_MMCCH-2 (K) | 2482 |
| 39 | 3386 | 3405 | 877.4165  | 2629.2277 | 2629.2271 | 0.23 | G | 2 | 21 | 0.0073 | LDHAYSLRDGHYYIAGPTKD +dK_MMCCH-2 (K) | 3404 |
| 40 | 38   | 55   | 1181.0392 | 2360.0638 | 2360.0478 | 6.78 | C | 3 | 14 | 0.036 | ALEKALDDLQQDDSNQGY +dK_MMCCH-2 (K) | 41 |
| 41 | 277  | 296  | 883.7539  | 2648.2399 | 2648.2329 | 2.64 | C | 4 | 39 | 0.00014 | DLTREHAKPADSFDYGRLGY +dK_MMCCH-2 (K) | 284 |

Figure 24 continued

| 42 | 364 | 373 | 735.3606 | 1468.7066 | 1468.7094 | -1.91 | C | 2 | 22 | 0.0067 | LLGGPTEMKW +dK_MMCCH-2 (K) | 372 |
| 43 | 432 | 443 | 793.9159 | 1585.8173 | 1585.8174 | -0.06 | C | 0 | 26 | 0.0028 | DKPPVPVAQANL +dK_MMCCH-2 (K) | 433 |
| 44 | 629 | 635 | 539.2532 | 1076.4919 | 1076.4848 | 6.60 | C | 0 | 20 | 0.0095 | VGGSEKY +dK_MMCCH-2 (K) | 634 |
| 45 | 1007 | 1015 | 669.8709 | 1337.7271 | 1337.7265 | 0.52 | C | 1 | 16 | 0.025 | TDIAKQVLL +dK_MMCCH-2 (K) | 1011 |
| 46 | 1075 | 1080 | 544.7770 | 1087.5395 | 1087.5372 | 2.11 | C | 1 | 26 | 0.0024 | QALQKY +dK_MMCCH-2 (K) | 1079 |
| 47 | 1125 | 1134 | 854.8459 | 1707.6772 | 1707.6763 | 0.59 | C | 3 | 33 | 0.00052 | DYKNNFDYEY +dK_MMCCH-2 (K) | 1127 |
| 48 | 1162 | 1177 | 690.0399 | 2067.0979 | 2067.0863 | 5.61 | C | 4 | 18 | 0.015 | AGFLLHEIGQSALVKF +dK_MMCCH-2 (K) | 1176 |
| 49 | 1298 | 1306 | 715.3727 | 1428.7309 | 1428.7323 | -0.91 | C | 1 | 20 | 0.01 | LQIQKEGIY +dK_MMCCH-2 (K) | 1302 |
| 50 | 1298 | 1312 | 824.0880 | 2469.2422 | 2469.2324 | 3.97 | C | 2 | 13 | 0.047 | LQIQKEGIYENIAKF +2 dK_MMCCH-2 (K) | 1302, 1311 |
| 51 | 1416 | 1426 | 863.3786 | 1724.7426 | 1724.7426 | 0.06 | C | 2 | 27 | 0.0022 | DNKDFYENVML +dK_MMCCH-2 (K) | 1418 |
| 52 | 1526 | 1540 | 749.6839 | 2246.0299 | 2246.0215 | 3.74 | C | 2 | 47 | 1.80E-05 | KHNLPQDSFDYQNRF +dK_MMCCH-2 (K) | 1526 |
| 53 | 1589 | 1606 | 784.3566 | 2350.0479 | 2350.0392 | 3.70 | C | 0 | 31 | 0.00075 | ICVEQGGEQNCKTKAGSF +dK_MMCCH-2 (K) | 1600 |
| 54 | 1589 | 1606 | 784.3541 | 2350.0404 | 2350.0392 | 0.51 | C | 0 | 30 | 0.001 | ICVEQGGEQNCKTKAGSF +dK_MMCCH-2 (K) | 1602 |
| 55 | 1696 | 1702 | 607.2995 | 1212.5844 | 1212.5849 | -0.41 | C | 1 | 27 | 0.002 | TTLEKHF +dK_MMCCH-2 (K) | 1700 |
| 56 | 1708 | 1719 | 839.8421 | 1677.6696 | 1677.6651 | 2.74 | C | 0 | 38 | 0.00017 | KNMQADDSPDGY +dK_MMCCH-2 (K) | 1708 |
| 57 | 1801 | 1809 | 706.8386 | 1411.6627 | 1411.6595 | 2.27 | C | 0 | 24 | 0.0044 | SHKTFPNPF +dK_MMCCH-2 (K) | 1803 |
| 58 | 1985 | 1995 | 850.4311 | 1698.8476 | 1698.8399 | 4.53 | C | 0 | 39 | 0.00012 | IKQQQEADRVF +dK_MMCCH-2 (K) | 1986 |
| 59 | 2001 | 2011 | 726.8469 | 1451.6792 | 1451.6755 | 2.48 | C | 1 | 27 | 0.0021 | KGFGQSASVSF +dK_MMCCH-2 (K) | 2001 |
| 60 | 2194 | 2207 | 1042.5349 | 2083.0553 | 2083.0489 | 3.07 | C | 3 | 15 | 0.035 | WDWTKPISKLPDLF +dK_MMCCH-2 (K) | 2202 |
| 61 | 2230 | 2236 | 582.2687 | 1162.5228 | 1162.5216 | 1.03 | C | 0 | 14 | 0.042 | IKSEDAY +dK_MMCCH-2 (K) | 2231 |
| 62 | 2463 | 2479 | 1128.0164 | 2254.0182 | 2254.0253 | -3.15 | C | 1 | 18 | 0.015 | KAQSHPEDVFDTDAPF +dK_MMCCH-2 (K) | 2463 |
| 63 | 2506 | 2532 | 761.6029 | 3042.3825 | 3042.3738 | 2.89 | C | 0 | 17 | 0.021 | SAGEGHTDDHGSDHIAGSGVRKDVTSL +dK_MMCCH-2 (K) | 2527 |
| 64 | 2754 | 2760 | 598.3301 | 1194.6457 | 1194.6471 | -1.17 | C | 1 | 15 | 0.029 | KQPLKPF +dK_MMCCH-2 (K) | 2754 |

Figure 24 continued

| | | | | | | | | | |
|---|---|---|---|---|---|---|---|---|---|
| 65 | 2754 | 2760 | 598.3317 | 1194.6489 | 1194.6471 | 1.51 | C | 1 | 23 | 0.005 | KQPLKPF +dK_MMCCH-2 (K) | 2758 |
| 66 | 2865 | 2872 | 673.3643 | 1344.7141 | 1344.7112 | 2.16 | C | 1 | 13 | 0.046 | RYDITKVL +dK_MMCCH-2 (K) | 2870 |
| 67 | 3235 | 3242 | 617.3138 | 1232.6131 | 1232.6111 | 1.62 | C | 0 | 20 | 0.0099 | TSANVKIY +dK_MMCCH-2 (K) | 3240 |
| 68 | 3399 | 3406 | 576.8038 | 1151.5930 | 1151.5896 | 2.87 | C | 0 | 20 | 0.0093 | IAGPTKDL +dK_MMCCH-2 (K) | 3404 |
| 69 | 69 | 75 | 604.2924 | 1206.5703 | 1206.5703 | 0.00 | Th | 0 | 22 | 0.0069 | VDKHEKN +dK_MMCCH-2 (K) | 74 |
| 70 | 165 | 175 | 558.6142 | 1672.8208 | 1672.8144 | 3.83 | Th | 1 | 23 | 0.0053 | FEKVQPCHHTR +dK_MMCCH-2 (K) | 167 |
| 71 | 180 | 191 | 909.9193 | 1817.8241 | 1817.8216 | 1.38 | Th | 4 | 57 | 2.20E-06 | ILDALEQDEFCK +dK_MMCCH-2 (K) | 191 |
| 72 | 247 | 260 | 631.6202 | 1891.8389 | 1891.8305 | 4.44 | Th | 2 | 15 | 0.032 | LRGKDPNSADCAHN +dK_MMCCH-2 (K) | 250 |
| 73 | 283 | 293 | 782.8608 | 1563.7070 | 1563.7028 | 2.69 | Th | 3 | 39 | 0.00014 | AKPADSFDYGR +dK_MMCCH-2 (K) | 284 |
| 74 | 365 | 372 | 585.7805 | 1169.5465 | 1169.5461 | 0.34 | Th | 1 | 43 | 5.50E-05 | LGGPTEMK +dK_MMCCH-2 (K) | 372 |
| 75 | 431 | 437 | 569.2866 | 1136.5586 | 1136.5576 | 0.79 | Th | 1 | 13 | 0.046 | FDKPPVP +dK_MMCCH-2 (K) | 433 |
| 76 | 467 | 472 | 538.7430 | 1075.4714 | 1075.4644 | 6.51 | Th | 0 | 14 | 0.045 | FQNDKS +dK_MMCCH-2 (K) | 471 |
| 77 | 554 | 565 | 811.8927 | 1621.7708 | 1621.7658 | 3.14 | Th | 1 | 15 | 0.029 | LDPVTGETKNNP +dK_MMCCH-2 (K) | 562 |
| 78 | 629 | 636 | 582.7668 | 1163.5191 | 1163.5169 | 1.98 | Th | 1 | 22 | 0.006 | VGGSEKYS +dK_MMCCH-2 (K) | 634 |
| 79 | 893 | 904 | 904.8956 | 1807.7767 | 1807.7698 | 3.82 | Th | 1 | 25 | 0.0035 | FHGEPKWCPSPE +dK_MMCCH-2 (K) | 898 |
| 80 | 1362 | 1374 | 968.4326 | 1934.8507 | 1934.8397 | 5.69 | Th | 4 | 16 | 0.026 | YWDWTEKADSLPS +dK_MMCCH-2 (K) | 1368 |
| 81 | 1414 | 1419 | 564.7549 | 1127.4952 | 1127.4957 | -0.44 | Th | 1 | 15 | 0.029 | LWDNKD +dK_MMCCH-2 (K) | 1418 |
| 82 | 1525 | 1539 | 738.3549 | 2212.0429 | 2212.0371 | 2.62 | Th | 3 | 48 | 1.50E-05 | LKHNLPQDSFDYQNR +dK_MMCCH-2 (K) | 1526 |
| 83 | 1589 | 1605 | 735.3308 | 2202.9706 | 2202.9708 | -0.09 | Th | 2 | 18 | 0.017 | ICVEQGGEQNCKTKAGS +dK_MMCCH-2 (K) | 1600 |
| 84 | 1589 | 1605 | 735.3312 | 2202.9717 | 2202.9708 | 0.41 | Th | 2 | 39 | 0.00012 | ICVEQGGEQNCKTKAGS +dK_MMCCH-2 (K) | 1602 |
| 85 | 1800 | 1809 | 780.3749 | 1558.7353 | 1558.7279 | 4.75 | Th | 2 | 18 | 0.016 | FSHKTFPNPF +dK_MMCCH-2 (K) | 1803 |
| 86 | 1952 | 1963 | 940.4234 | 1878.8322 | 1878.8247 | 4.05 | Th | 2 | 28 | 0.0015 | FSKPEDTFDYHR +dK_MMCCH-2 (K) | 1954 |
| 87 | 1985 | 1994 | 776.8957 | 1551.7768 | 1551.7715 | 3.42 | Th | 2 | 22 | 0.0062 | IKQQQEADRV +dK_MMCCH-2 (K) | 1986 |

Figure 24 continued

| 88 | 2193 | 2199 | 667.3019 | 1332.5892 | 1332.5849 | 3.23 | Th | 2 | 27 | 0.0021 | YWDWTKP +dK_MMCCH-2 (K) | 2198 |
| 89 | 2200 | 2206 | 562.3099 | 1122.6052 | 1122.5995 | 5.08 | Th | 2 | 24 | 0.004 | ISKLPDL +dK_MMCCH-2 (K) | 2202 |
| 90 | 2225 | 2229 | 462.2227 | 922.4309 | 922.4259 | 5.42 | Th | 2 | 17 | 0.022 | FAKGY +dK_MMCCH-2 (K) | 2227 |
| 91 | 2359 | 2363 | 509.2313 | 1016.4481 | 1016.4460 | 2.07 | Th | 1 | 14 | 0.04 | FTKMH +dK_MMCCH-2 (K); Oxidation (M) | 2361 |
| 92 | 2941 | 2950 | 720.8409 | 1439.6672 | 1439.6602 | 4.86 | Th | 3 | 42 | 5.90E-05 | LDEANDLKNA +dK_MMCCH-2 (K) | 2948 |
| 93 | 3000 | 3015 | 573.2752 | 1144.5359 | 1144.5335 | 2.01 | Th | 0 | 15 | 0.031 | LKEHGSH +dK_MMCCH-2 (K) | 3010 |
| 94 | 3020 | 3026 | 662.2903 | 1322.5661 | 1322.5642 | 1.51 | Th | 2 | 28 | 0.0017 | YWDWTKS +dK_MMCCH-2 (K) | 3025 |
| 95 | 3399 | 3405 | 520.2604 | 1038.5062 | 1038.5056 | 0.58 | Th | 1 | 27 | 0.002 | IAGPTKD +dK_MMCCH-2 (K) | 3404 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the lysine conjugation site for KLH1 or KLH2.

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 124 | 141 | 785.4103 | 2353.2092 | 2353.2001 | 3.87 | T | 1 | 19 | 0.011 | GFTDPPVKHHQSANLLVR +dK_MMCCH-2 (K) | 131 |
| 2 | 142 | 149 | 656.3425 | 1310.6705 | 1310.6653 | 4.04 | T | 1 | 35 | 0.00034 | KNINDLTR +dK_MMCCH-2 (K) | 142 |
| 3 | 157 | 166 | 822.8790 | 1643.7435 | 1643.7402 | 2.01 | T | 1 | 18 | 0.016 | EAFHKFQEDR +dK_MMCCH-2 (K) | 161 |
| 4 | 184 | 192 | 726.8442 | 1451.6738 | 1451.6649 | 6.13 | T | 1 | 22 | 0.0061 | CPRPDAKDR +dK_MMCCH-2 (K) | 190 |
| 5 | 470 | 488 | 748.0502 | 2241.1289 | 2241.1100 | 8.43 | T | 1 | 24 | 0.0039 | TTDSVQHKAGTFAVLGGSK +dK_MMCCH-2 (K) | 477 |
| 6 | 553 | 560 | 663.8695 | 1325.7245 | 1325.7166 | 5.96 | T | 1 | 22 | 0.0058 | VKFDKVPR +dK_MMCCH-2 (K) | 554 |
| 7 | 553 | 560 | 555.6243 | 1663.8510 | 1663.8466 | 2.64 | T | 2 | 15 | 0.029 | VKFDKVPR +2 dK_MMCCH-2 (K) | 554, 557 |
| 8 | 566 | 570 | 485.2455 | 968.4765 | 968.4749 | 1.65 | T | 1 | 17 | 0.022 | KNVDR +dK_MMCCH-2 (K) | 566 |
| 9 | 581 | 590 | 733.9194 | 1465.8242 | 1465.8214 | 1.91 | T | 2 | 40 | 0.00011 | KALALLKEDK +dK_MMCCH-2 (K) | 581 |
| 10 | 588 | 606 | 781.0386 | 2340.0941 | 2340.0845 | 4.10 | T | 1 | 21 | 0.008 | EDKSAGGFQQLGAFHGEPK +dK_MMCCH-2 (K) | 590 |
| 11 | 591 | 615 | 1004.4697 | 3010.3872 | 3010.3742 | 4.32 | T | 1 | 18 | 0.015 | SAGGFQQLGAFHGEPKWCPSPEASK +dK_MMCCH-2 (K) | 606 |
| 12 | 645 | 681 | 1158.5359 | 4630.1145 | 4630.1063 | 1.75 | T | 1 | 21 | 0.0072 | HGYDGALPYWDWTSPLNHLPELADHEKYVDPEDGVEK +dK_MMCCH-2 (K) | 671 |
| 13 | 682 | 699 | 620.2941 | 2477.1474 | 2477.1434 | 1.61 | T | 1 | 23 | 0.0045 | HNPWFDGHIDTVDKTTTR +dK_MMCCH-2 (K) | 695 |
| 14 | 700 | 719 | 887.7753 | 2660.3040 | 2660.2945 | 3.57 | T | 1 | 32 | 0.00064 | SVQNKLFEQPEFGHYTSIAK +dK_MMCCH-2 (K) | 704 |
| 15 | 790 | 804 | 1003.4777 | 2004.9409 | 2004.9220 | 9.43 | T | 0 | 63 | 5.00E-07 | GKPYNVANCAVTSMR +dK_MMCCH-2 (K) | 791 |
| 16 | 953 | 965 | 635.3326 | 1902.9761 | 1902.9662 | 5.20 | T | 1 | 46 | 2.40E-05 | DLFKQPSVIHEPR +dK_MMCCH-2 (K) | 956 |
| 17 | 986 | 1000 | 685.0287 | 2052.0642 | 2052.0561 | 4.00 | T | 1 | 68 | 1.80E-07 | KNIENLSLGELESLR +dK_MMCCH-2 (K) | 986 |
| 18 | 1048 | 1060 | 913.5324 | 1825.0503 | 1825.0423 | 4.38 | T | 1 | 19 | 0.013 | LYVVVENALLKK +dK_MMCCH-2 (K) | 1060 |

| | | | | | | | | | | | |
|---|---|---|---|---|---|---|---|---|---|---|---|
| 19 | 1092 | 1114 | 633.7048 | 3163.4875 | 3163.4682 | 6.07 | T | 1 | 40 | 0.0001 | QHHYETNPFHHGKITHENEITTR +dK_MMCCH-2 (K) | 1104 |
| 20 | 1199 | 1203 | 353.1928 | 1056.5566 | 1056.5538 | 2.65 | T | 1 | 17 | 0.019 | KRPYR +dK_MMCCH-2 (K) | 1199 |
| 21 | 1395 | 1403 | 485.5976 | 1453.7709 | 1453.7599 | 7.57 | T | 2 | 29 | 0.0014 | KDITQLDKR +dK_MMCCH-2 (K) | 1395 |
| 22 | 1395 | 1403 | 598.3081 | 1791.9025 | 1791.8899 | 7.03 | T | 2 | 15 | 0.03 | KDITQLDKR +2 dK_MMCCH-2 (K) | 1395,1402 |
| 23 | 1473 | 1489 | 778.4055 | 2332.1946 | 2332.1827 | 5.10 | T | 1 | 46 | 2.80E-05 | KHGAVVGLPYWDWTLPR +dK_MMCCH-2 (K) | 1473 |
| 24 | 1721 | 1746 | 1087.4788 | 3259.4145 | 3259.3937 | 6.38 | T | 1 | 15 | 0.031 | TAGDCEDACYTVLGGEKEMPWAFDR +dK_MMCCH-2 (K) | 1738 |
| 25 | 1747 | 1758 | 613.9782 | 1838.9128 | 1838.9012 | 6.31 | T | 1 | 27 | 0.0019 | LYKYDITETLDK +dK_MMCCH-2 (K) | 1749 |
| 26 | 1890 | 1922 | 1099.5339 | 4394.1067 | 4394.1048 | 0.43 | T | 1 | 13 | 0.048 | HGSSVAVPVWDWTKPIHNIPHLFTDKEYDVWR +dK_MMCCH-2 (K) | 1915 |
| 27 | 1923 | 1932 | 756.3811 | 1510.7476 | 1510.7425 | 3.44 | T | 1 | 21 | 0.0077 | NKVMPNPFAR +dK_MMCCH-2 (K) | 1924 |
| 28 | 2100 | 2109 | 492.2501 | 1964.9713 | 1964.9601 | 5.70 | T | 2 | 21 | 0.0075 | EIKDKQHHVR +2 dK_MMCCH-2 (K) | 2102, 2104 |
| 29 | 2121 | 2149 | 890.4190 | 3557.6469 | 3557.6378 | 2.56 | T | 1 | 29 | 0.0012 | TSADVQFQICKTSEDCHHGGQIFVLGGTK +dK_MMCCH-2 (K) | 2131 |
| 30 | 2359 | 2367 | 736.3516 | 1470.6887 | 1470.6813 | 5.03 | T | 1 | 35 | 0.00032 | DKLFNDPER +dK_MMCCH-2 (K) | 2360 |
| 31 | 2507 | 2514 | 682.3550 | 1362.6955 | 1362.6853 | 7.49 | T | 1 | 22 | 0.0065 | KLEHELEK +dK_MMCCH-2 (K) | 2507 |
| 32 | 2515 | 2520 | 571.7631 | 1141.5117 | 1141.5074 | 3.77 | T | 1 | 19 | 0.013 | QKEEDR +dK_MMCCH-2 (K) | 2516 |
| 33 | 2621 | 2636 | 802.7125 | 2405.1157 | 2405.1083 | 3.08 | T | 1 | 47 | 2.10E-05 | HHEKHHEDHHEDILVR +dK_MMCCH-2 (K) | 2624 |
| 34 | 2637 | 2651 | 713.3571 | 2137.0495 | 2137.0374 | 5.66 | T | 1 | 69 | 1.40E-07 | KNIHSLSHHEAEELR +dK_MMCCH-2 (K) | 2637 |
| 35 | 2657 | 2686 | 1246.2233 | 3735.6480 | 3735.6358 | 3.24 | T | 1 | 17 | 0.019 | LQNDESHGGYEHIAGFHGYPNLCPEKGDEK +dK_MMCCH-2 (K) | 2686 |
| 36 | 2851 | 2883 | 807.5757 | 4032.8423 | 4032.8346 | 1.91 | T | 0 | 45 | 3.50E-05 | VKPAHAGSCAGDIMHVPLHPFNYESVNNDDFTR +dK_MMCCH-2 (K) | 2852 |
| 37 | 2897 | 2919 | 800.1410 | 3196.5351 | 3196.5287 | 2.00 | T | 1 | 53 | 5.10E-06 | FNYKYDNLNLHGHNIEELEEVLR +dK_MMCCH-2 (K) | 2900 |
| 38 | 3003 | 3021 | 825.7765 | 2474.3076 | 2474.2879 | 7.96 | T | 1 | 41 | 7.90E-05 | KYDHTELDASVLPAPIIVR +dK_MMCCH-2 (K) | 3003 |
| 39 | 123 | 151 | 807.4167 | 4032.0474 | 4032.0350 | 3.08 | G | 2 | 24 | 0.0036 | KGFTDPPVKHHQSANLLVRKNINDLTREE +2 dK_MMCCH-2 (K) | 123, 131 |
| 40 | 123 | 151 | 800.1410 | 3693.9251 | 3693.9049 | 5.47 | G | 2 | 33 | 0.00049 | KGFTDPPVKHHQSANLLVRKNINDLTREE +dK_MMCCH-2 (K) | 131 |
| 41 | 158 | 176 | 846.7141 | 2537.1203 | 2537.1169 | 1.34 | G | 3 | 23 | 0.0052 | AFHKFQEDRSVDGYQATAE +Deamidated (NQ); dK_MMCCH-2 (K) | 161 |

Figure 25 continued

| | | | | | | | | | |
|---|---|---|---|---|---|---|---|---|---|
| 42 | 435 | 442 | 676.3256 | 1350.6366 | 1350.6312 | 4.00 | G | 1 | 14 | 0.038 | NIEKMIHE +dK_MMCCH-2 (K) | 438 |
| 43 | 526 | 544 | 777.7495 | 2330.2265 | 2330.2304 | -1.67 | G | 1 | 29 | 0.0013 | VDGTKLASSLIPHASVIRE +dK_MMCCH-2 (K) | 530 |
| 44 | 589 | 612 | 1102.8308 | 3305.4706 | 3305.4621 | 2.60 | G | 1 | 14 | 0.037 | DKSAGGFQQLGAFHGEPKWCPSPE +2 dK_MMCCH-2 (K) | 590, 606 |
| 45 | 589 | 612 | 990.1188 | 2967.3345 | 2967.3320 | 0.84 | G | 1 | 28 | 0.0015 | DKSAGGFQQLGAFHGEPKWCPSPE +dK_MMCCH-2 (K) | 606 |
| 46 | 825 | 841 | 820.3754 | 2458.1045 | 2458.0940 | 4.27 | G | 1 | 25 | 0.003 | HSVPFNVFDYKTNFNYE +dK_MMCCH-2 (K) | 835 |
| 47 | 847 | 860 | 965.0179 | 1928.0212 | 1928.0077 | 7.00 | C | 0 | 17 | 0.018 | FNGLSISQLNKKLE +dK_MMCCH-2 (K) | 858 |
| 48 | 942 | 970 | 908.9860 | 3631.9147 | 3631.8973 | 4.79 | G | 2 | 20 | 0.01 | VFDLKPASLGKDLFKQPSVIHEPRIGHHE +dK_MMCCH-2 (K) | 956 |
| 49 | 1055 | 1076 | 810.1685 | 3236.6450 | 3236.6402 | 1.45 | G | 1 | 14 | 0.041 | NALLKKGSSVAVPYWDWTKRIE +2 dK_MMCCH-2 (K) | 1059, 1060 |
| 50 | 1055 | 1076 | 725.6360 | 2898.5149 | 2898.5102 | 1.62 | G | 1 | 18 | 0.018 | NALLKKGSSVAVPYWDWTKRIE +dK_MMCCH-2 (K) | 1073 |
| 51 | 1097 | 1110 | 999.9629 | 1997.9112 | 1997.9054 | 2.90 | G | 1 | 20 | 0.011 | TNPFHHGKITHENE +dK_MMCCH-2 (K) | 1104 |
| 52 | 1376 | 1396 | 864.3887 | 2590.1444 | 2590.1428 | 0.58 | G | 3 | 27 | 0.0021 | AGTDSAHTDDGHTEPVMIRKD +dK_MMCCH-2 (K) | 1395 |
| 53 | 1397 | 1413 | 774.4371 | 2320.2894 | 2320.2824 | 3.02 | G | 1 | 15 | 0.035 | ITQLDKRQQLSLVKALE +dK_MMCCH-2 (K) | 1402 |
| 54 | 1397 | 1413 | 774.4396 | 2320.2969 | 2320.2824 | 6.25 | G | 1 | 21 | 0.0089 | ITQLDKRQQLSLVKALE +dK_MMCCH-2 (K) | 1410 |
| 55 | 1506 | 1522 | 753.3802 | 2257.1187 | 2257.1089 | 4.34 | G | 2 | 27 | 0.0022 | TGRDIPNPFIGSKIEFE +dK_MMCCH-2 (K) | 1518 |
| 56 | 1755 | 1765 | 570.6056 | 1708.7949 | 1708.7913 | 2.17 | G | 2 | 31 | 0.00077 | TLDKMNLRHDE +dK_MMCCH-2 (K) | 1758 |
| 57 | 2059 | 2078 | 777.1311 | 3104.4953 | 3104.4888 | 2.09 | G | 1 | 18 | 0.018 | INHNQFTKKHAVPNDVFKYE +2 dK_MMCCH-2 (K) | 2067, 2076 |
| 58 | 2089 | 2100 | 854.4106 | 1706.8066 | 1706.8008 | 3.46 | G | 2 | 29 | 0.0012 | IGGMNLHEIEKE +dK_MMCCH-2 (K) | 2099 |
| 59 | 2647 | 2661 | 715.6794 | 2144.0163 | 2144.0095 | 3.17 | G | 4 | 29 | 0.0012 | AEELRDALYKLQNDE +dK_MMCCH-2 (K) | 2656 |
| 60 | 2765 | 2774 | 753.8675 | 1505.7204 | 1505.7225 | -1.33 | G | 0 | 14 | 0.041 | AIFQQTKFGE +dK_MMCCH-2 (K) | 2771 |
| 61 | 3090 | 3097 | 632.8040 | 1263.5935 | 1263.5879 | 4.43 | G | 0 | 16 | 0.027 | LGKMYSVE +dK_MMCCH-2 (K) | 3092 |
| 62 | 94 | 100 | 573.2996 | 1144.5847 | 1144.5838 | 0.79 | C | 1 | 16 | 0.027 | TVKAELF +dK_MMCCH-2 (K) | 96 |
| 63 | 468 | 481 | 935.9766 | 1869.9387 | 1869.9295 | 4.92 | C | 0 | 22 | 0.0061 | IKTTDSVQHKAGTF +dK_MMCCH-2 (K) | 469 |
| 64 | 584 | 595 | 787.3998 | 1572.7851 | 1572.7858 | -0.38 | C | 2 | 32 | 0.00063 | ALLKEDKSAGGF +dK_MMCCH-2 (K) | 590 |

Figure 25 continued

| | | | | | | | | | | | | |
|---|---|---|---|---|---|---|---|---|---|---|---|---|
| 65 | 715 | 723 | 655.8738 | 1309.7331 | 1309.7316 | 1.22 | C | 1 | 15 | 0.029 | TSIAKQVLL +dK_MMCCH-2 (K) | 719 |
| 66 | 783 | 788 | 544.7775 | 1087.5404 | 1087.5372 | 2.94 | C | 1 | 34 | 0.0004 | QALQKY +dK_MMCCH-2 (K) | 787 |
| 67 | 830 | 838 | 743.3415 | 1484.6684 | 1484.6646 | 2.56 | C | 2 | 16 | 0.025 | NVFDYKTNF +dK_MMCCH-2 (K) | 835 |
| 68 | 860 | 869 | 789.8851 | 1577.7556 | 1577.7548 | 0.51 | C | 1 | 13 | 0.047 | EAIKSQDRFF +dK_MMCCH-2 (K) | 863 |
| 69 | 956 | 974 | 638.3217 | 2549.2578 | 2549.2485 | 3.65 | C | 0 | 15 | 0.029 | KQPSVIHEPRIGHHEGEVY +dK_MMCCH-2 (K) | 956 |
| 70 | 1330 | 1337 | 620.3554 | 1238.6963 | 1238.6944 | 1.45 | C | 1 | 26 | 0.0028 | KLDITKAL +dK_MMCCH-2 (K) | 1335 |
| 71 | 1580 | 1586 | 544.2607 | 1086.5069 | 1086.5056 | 1.20 | C | 0 | 14 | 0.038 | VGGKEPY +dK_MMCCH-2 (K) | 1583 |
| 72 | 1649 | 1664 | 752.3309 | 2253.9708 | 2253.9637 | 3.15 | C | 2 | 17 | 0.02 | NLNDHTHDFSKPEDTF +dK_MMCCH-2 (K) | 1659 |
| 73 | 1818 | 1827 | 753.3695 | 1504.7245 | 1504.7232 | 0.86 | C | 1 | 25 | 0.0031 | SERDIGSLKY +dK_MMCCH-2 (K) | 1826 |
| 74 | 2076 | 2082 | 612.3039 | 1222.5932 | 1222.5944 | -0.90 | C | 3 | 19 | 0.013 | KYELLGY +dK_MMCCH-2 (K) | 2076 |
| 75 | 2476 | 2488 | 923.9219 | 1845.8293 | 1845.8244 | 2.71 | C | 1 | 20 | 0.0097 | THSNAKPTDVFEY +dK_MMCCH-2 (K) | 2481 |
| 76 | 2656 | 2666 | 793.3512 | 1584.6878 | 1584.6879 | 0.00 | C | 1 | 22 | 0.0057 | KLQNDESHGGY +dK_MMCCH-2 (K) | 2656 |
| 77 | 2713 | 2723 | 787.9122 | 1573.8099 | 1573.8075 | 1.52 | C | 1 | 14 | 0.042 | KKHGSHLGIPY +dK_MMCCH-2 (K) | 2714 |
| 78 | 2809 | 2815 | 538.2603 | 1074.5059 | 1074.5056 | 0.37 | C | 0 | 19 | 0.014 | IGGAEKY +dK_MMCCH-2 (K) | 2814 |
| 79 | 2934 | 2945 | 816.4465 | 1630.8785 | 1630.8753 | 1.96 | C | 0 | 17 | 0.02 | SGIRTTAVVKVY +dK_MMCCH-2 (K) | 2943 |
| 80 | 2946 | 2960 | 965.4076 | 1928.8007 | 1928.7986 | 1.09 | C | 1 | 26 | 0.0027 | IKSGTDSDDEYAGSF +dK_MMCCH-2 (K) | 2947 |
| 81 | 2964 | 2971 | 607.2730 | 1212.5315 | 1212.5307 | 0.58 | C | 0 | 20 | 0.0092 | GGAKEMPW +dK_MMCCH-2 (K) | 2967 |
| 82 | 1 | 9 | 725.3406 | 1448.6667 | 1448.6667 | 6.90 | Th | 2 | 23 | 0.0054 | MTPEELKTY +dK_MMCCH-2 (K) | 7 |
| 83 | 38 | 56 | 861.6813 | 2582.0222 | 2582.0108 | 4.42 | Th | 2 | 13 | 0.047 | VCIPDDNDRNDDHCEKAGD +dK_MMCCH-2 (K) | 53 |
| 84 | 59 | 69 | 785.3785 | 1568.7424 | 1568.7367 | 3.63 | Th | 3 | 66 | 2.60E-07 | VLGGPSEMKWQ +dK_MMCCH-2 (K) | 67 |
| 85 | 78 | 84 | 569.2871 | 1136.5597 | 1136.5536 | 5.37 | Th | 1 | 49 | 1.20E-05 | LSDTVHK +dK_MMCCH-2 (K) | 84 |
| 86 | 116 | 124 | 447.2341 | 1338.6804 | 1338.6755 | 3.66 | Th | 2 | 31 | 0.00079 | VVVHHPEKG +dK_MMCCH-2 (K) | 123 |
| 87 | 125 | 135 | 815.8884 | 1629.7623 | 1629.7610 | 0.80 | Th | 1 | 16 | 0.023 | FTDPPVKHHQS +dK_MMCCH-2 (K) | 131 |

Figure 25 continued

| | | | | | | | | | | |
|---|---|---|---|---|---|---|---|---|---|---|
| 88 | 431 | 439 | 707.8542 | 1413.6938 | 1413.6883 | 3.89 | Th | 3 | 36 | 0.00025 | ISLENIEKM +dK_MMCCH-2 (K) | 438 |
| 89 | 519 | 530 | 807.9007 | 1613.7868 | 1613.7859 | 0.62 | Th | 3 | 60 | 9.80E-07 | VTVDITEVDGTK +dK_MMCCH-2 (K) | 530 |
| 90 | 585 | 591 | 585.8112 | 1169.6079 | 1169.6002 | 6.58 | Th | 1 | 26 | 0.0023 | LLKEDKS +dK_MMCCH-2 (K) | 590 |
| 91 | 601 | 612 | 904.8990 | 1807.7834 | 1807.7698 | 7.52 | Th | 1 | 25 | 0.0032 | FHGEPKWCPSPE +dK_MMCCH-2 (K) | 606 |
| 92 | 666 | 672 | 607.2826 | 1212.5507 | 1212.5485 | 1.90 | Th | 2 | 24 | 0.0039 | LADHEKY +dK_MMCCH-2 (K) | 671 |
| 93 | 829 | 837 | 743.3404 | 1484.6662 | 1484.6646 | 1.08 | Th | 3 | 21 | 0.0087 | FNVFDYKTN +dK_MMCCH-2 (K) | 835 |
| 94 | 1066 | 1074 | 530.2600 | 1587.7580 | 1587.7544 | 2.27 | Th | 3 | 14 | 0.043 | VPYWDWTKR +dK_MMCCH-2 (K) | 1073 |
| 95 | 1111 | 1120 | 742.3792 | 1482.7439 | 1482.7388 | 3.37 | Th | 1 | 16 | 0.025 | ITTRDPKDSL +dK_MMCCH-2 (K) | 1117 |
| 96 | 1219 | 1232 | 766.6617 | 2296.9634 | 2296.9617 | 0.74 | Th | 1 | 17 | 0.018 | FDKSDNNDEATKTH +2 dK_MMCCH-2 (K) | 1221, 1230 |
| 97 | 1219 | 1232 | 980.4233 | 1958.8321 | 1958.8316 | 0.26 | Th | 1 | 38 | 0.00014 | FDKSDNNDEATKTH +dK_MMCCH-2 (K) | 1230 |
| 98 | 1657 | 1668 | 921.9182 | 1841.8219 | 1841.8182 | 2.01 | Th | 2 | 56 | 2.60E-06 | FSKPEDTFDYQK +dK_MMCCH-2 (K) | 1659 |
| 99 | 1657 | 1668 | 921.9215 | 1841.8283 | 1841.8182 | 5.48 | Th | 2 | 57 | 2.20E-06 | FSKPEDTFDYQK +dK_MMCCH-2 (K) | 1668 |
| 100 | 1733 | 1741 | 664.3221 | 1326.6297 | 1326.6312 | -1.13 | Th | 2 | 18 | 0.016 | VLGGEKEMP +dK_MMCCH-1 (K); Oxidation (M) | 1738 |
| 101 | 1894 | 1904 | 850.4122 | 1698.8098 | 1698.8116 | -1.06 | Th | 5 | 37 | 0.00022 | VAVPYWDWTKP +dK_MMCCH-2 (K) | 1903 |
| 102 | 2064 | 2068 | 499.7597 | 997.5048 | 997.5055 | -0.70 | Th | 0 | 21 | 0.008 | FTKKH +dK_MMCCH-2 (K) | 2067 |
| 103 | 2094 | 2100 | 618.3042 | 1234.5938 | 1234.5903 | 2.83 | Th | 1 | 27 | 0.0022 | LHEIEKE +dK_MMCCH-2 (K) | 2099 |
| 104 | 2238 | 2248 | 778.8801 | 1555.7457 | 1555.7440 | 1.09 | Th | 3 | 48 | 1.70E-05 | LTTAEVDNLKD +dK_MMCCH-2 (K) | 2247 |
| 105 | 2475 | 2490 | 746.3550 | 2236.0431 | 2236.0259 | 7.69 | Th | 4 | 22 | 0.006 | FTHSNAKPTDVFEYSR +dK_MMCCH-2 (K) | 2481 |
| 106 | 2512 | 2521 | 807.3973 | 1612.7801 | 1612.7766 | 2.17 | Th | 0 | 29 | 0.0013 | LEKQKEEDRT +dK_MMCCH-2 (K) | 2514 |
| 107 | 2508 | 2521 | 708.0122 | 2121.0148 | 2121.0048 | 4.71 | Th | 1 | 17 | 0.019 | LEHELEKQKEEDRT +dK_MMCCH-2 (K) | 2516 |
| 108 | 2595 | 2606 | 806.4047 | 1610.7949 | 1610.7862 | 5.40 | Th | 2 | 28 | 0.0016 | IIDTSGKQLPSD +dK_MMCCH-2 (K) | 2601 |
| 109 | 2607 | 2612 | 520.7805 | 1039.5465 | 1039.5446 | 1.83 | Th | 2 | 19 | 0.013 | LIKMPT +dK_MMCCH-2 (K) | 2609 |
| 110 | 2766 | 2771 | 551.7868 | 1101.5590 | 1101.5529 | 5.63 | Th | 1 | 29 | 0.0012 | IFQQTK +dK_MMCCH-2 (K) | 2771 |

Figure 25 continued

| 111 | 2808 | 2816 | 638.3200 | 1274.6255 | 1274.6217 | 2.98 | Th | 3 | 27 | 0.0018 | LIGGAEKYS +dK_MMCCH-2 (K) | 2814 |
| 112 | 2946 | 2960 | 965.4102 | 1928.8059 | 1928.7986 | 3.78 | Th | 3 | 30 | 0.0011 | IKSGTDSDDEYAGSF +dK_MMCCH-2 (K) | 2947 |
| 113 | 2961 | 2970 | 691.8640 | 1381.7135 | 1381.7098 | 2.68 | Th | 4 | 18 | 0.016 | VILGGAKEMP +dK_MMCCH-1 (K); Oxidation (M) | 2967 |
| 114 | 2990 | 2996 | 583.2845 | 1164.5544 | 1164.5485 | 5.07 | Th | 1 | 38 | 0.00017 | LTDDHVK +dK_MMCCH-2 (K) | 2996 |

Figure 25 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1043.0275 | 2084.0404 | 2084.0347 | 2.74 | T | 1 | 49 | 1.20E-05 | KNVDSLSSDEVLALEK +dK_MMCCH-2 (K) | 26 |
| 2 | 147 | 155 | 694.3721 | 1386.7297 | 1386.7217 | 5.77 | T | 1 | 35 | 0.00029 | ADITFLNKK +dK_MMCCH-2 (K) | 155 |
| 3 | 164 | 175 | 596.3124 | 1785.9155 | 1785.8985 | 9.52 | T | 1 | 42 | 6.60E-05 | LFEKVQPGHHTR +dK_MMCCH-2 (K) | 167 |
| 4 | 249 | 271 | 987.4443 | 2959.3110 | 2959.3051 | 1.99 | T | 1 | 36 | 0.00024 | GKDPNSADCAHNLIHTPMEPFDR +dK_MMCCH-2 (K) | 250 |
| 5 | 281 | 293 | 610.9466 | 1829.8179 | 1829.8043 | 7.49 | T | 0 | 54 | 4.30E-06 | EHAKPADSFDYGR +dK_MMCCH-2 (K) | 284 |
| 6 | 419 | 446 | 677.3707 | 3381.8173 | 3381.8132 | 1.21 | T | 1 | 27 | 0.0022 | QPTLVHRPAKGHFDKPPVPVAQANLAVR +Deamidated (NQ); dK_MMCCH-2 (K) | 428 |
| 7 | 429 | 446 | 752.0682 | 2253.1829 | 2253.1729 | 4.44 | T | 0 | 52 | 5.90E-06 | GHFDKPPVPVAQANLAVR +dK_MMCCH-2 (K) | 433 |
| 8 | 467 | 488 | 708.5943 | 2830.3481 | 2830.3385 | 3.39 | T | 1 | 69 | 1.30E-07 | FQNDKSVDGYQATVEFHALPAR +dK_MMCCH-2 (K) | 471 |
| 9 | 489 | 497 | 726.8442 | 1451.6738 | 1451.6649 | 6.13 | T | 1 | 22 | 0.0061 | CPRPDAKDR +dK_MMCCH-2 (K) | 495 |
| 10 | 936 | 950 | 720.3452 | 2158.0138 | 2158.0095 | 1.99 | T | 1 | 30 | 0.00097 | KHGFTGGLPYWDWTR +dK_MMCCH-2 (K) | 936 |
| 11 | 1082 | 1096 | 996.4687 | 1990.9228 | 1990.9063 | 8.29 | T | 0 | 46 | 2.70E-05 | GKPYNTANCAIASMR +dK_MMCCH-2 (K) | 1083 |
| 12 | 1097 | 1115 | 827.0787 | 2478.2142 | 2478.2101 | 1.65 | T | 0 | 66 | 2.30E-07 | KPLQPFGLDSVINPDDETR +dK_MMCCH-2 (K) | 1097 |
| 13 | 1123 | 1149 | 1190.5612 | 3568.6617 | 3568.6497 | 3.36 | T | 1 | 79 | 1.20E-08 | VFDYKNNFDYEYESLAFNGLSIAQLDR +dK_MMCCH-2 (K) | 1127 |
| 14 | 1355 | 1385 | 1271.2694 | 3810.7864 | 3810.7876 | -0.31 | T | 1 | 38 | 0.00015 | GSAVAVPYWDWTEKADSLPSLINDATYFNSR +dK_MMCCH-2 (K) | 1368 |
| 15 | 1409 | 1450 | 1097.7141 | 5483.5342 | 5483.5213 | 2.35 | T | 1 | 40 | 9.60E-05 | DPQPELWDNKDFYENVMLALEQDNFCDFEIQLELIHNALHSR +dK_MMCCH-2 (K) | 1418 |
| 16 | 1455 | 1480 | 1117.8821 | 3350.6244 | 3350.6070 | 5.19 | T | 1 | 34 | 0.00044 | AKYSLSSLDYTAFDPVFFLHHANVDR +dK_MMCCH-2 (K) | 1456 |
| 17 | 1493 | 1507 | 721.6577 | 2161.9513 | 2161.9594 | -3.75 | T | 1 | 66 | 2.40E-07 | KKPYNEADCAVNEMR +dK_MMCCH-2 (K) | 1494 |
| 18 | 1542 | 1564 | 802.8964 | 3207.5566 | 3207.5448 | 3.68 | T | 1 | 19 | 0.013 | YQYDNLQFNHFSIQKLDQTIQAR +dK_MMCCH-2 (K) | 1556 |

Figure 25 continued

| | | | | | | | | | | |
|---|---|---|---|---|---|---|---|---|---|---|
| 19 | 1622 | 1633 | 591.9822 | 1772.9247 | 1772.9171 | 4.29 | T | 1 | 30 | 0.00093 | LYKFDITSALHK +dK_MMCCH-2 (K) | 1624 |
| 20 | 1690 | 1704 | 532.2896 | 2125.1293 | 2125.1241 | 2.45 | T | 2 | 23 | 0.0046 | KEVSSLTTLEKHFLR +dK_MMCCH-2 (K) | 1700 |
| 21 | 1757 | 1768 | 612.9798 | 1835.9176 | 1835.9128 | 2.61 | T | 1 | 16 | 0.027 | LYTVQFEDSLKR +dK_MMCCH-2 (K) | 1767 |
| 22 | 1949 | 1963 | 560.2533 | 2236.9841 | 2236.9735 | 4.74 | T | 0 | 48 | 1.60E-05 | TQEFSKPEDTFDYHR +dK_MMCCH-2 (K) | 1954 |
| 23 | 2218 | 2231 | 937.4839 | 1872.9532 | 1872.9444 | 4.70 | T | 1 | 23 | 0.0049 | DAVVNNPFAKGYIK +dK_MMCCH-2 (K) | 2231 |
| 24 | 2400 | 2404 | 479.2450 | 956.4754 | 956.4749 | 0.52 | T | 1 | 16 | 0.025 | KSQTR +dK_MMCCH-2 (K) | 2400 |
| 25 | 2453 | 2463 | 839.9330 | 1677.8515 | 1677.8436 | 4.71 | T | 1 | 16 | 0.026 | NFKYDITQALK +dK_MMCCH-2 (K) | 2455 |
| 26 | 2527 | 2541 | 1007.5168 | 2013.0190 | 2013.0088 | 5.07 | T | 1 | 18 | 0.017 | KDVTSLTASEIENLR +dK_MMCCH-2 (K) | 2527 |
| 27 | 2755 | 2764 | 764.3846 | 1526.7546 | 1526.7439 | 7.01 | T | 0 | 37 | 0.00019 | QPLKPFSESR +Deamidated (NQ); dK_MMCCH-2 (K) | 2758 |
| 28 | 2810 | 2814 | 455.8921 | 1364.6544 | 1364.6468 | 5.50 | T | 2 | 15 | 0.031 | KKEER +2 dK_MMCCH-2 (K) | 2810, 2811 |
| 29 | 2866 | 2873 | 659.3627 | 1316.7108 | 1316.7050 | 4.40 | T | 1 | 16 | 0.023 | YDITKVLK +dK_MMCCH-2 (K) | 2870 |
| 30 | 3148 | 3155 | 629.3372 | 1256.6599 | 1256.6587 | 0.95 | T | 1 | 20 | 0.0093 | KKPYNAAK +dK_MMCCH-2 (K) | 3149 |
| 31 | 167 | 178 | 590.9643 | 1769.8710 | 1769.8705 | 0.28 | G | 0 | 22 | 0.0059 | KVQPGHHTRLME +dK_MMCCH-2 (K) | 167 |
| 32 | 311 | 322 | 567.6295 | 1699.8666 | 1699.8603 | 3.65 | G | 1 | 17 | 0.022 | LNVYLGERAAKE +dK_MMCCH-2 (K) | 321 |
| 33 | 433 | 456 | 975.8561 | 2924.5464 | 2924.5429 | 1.20 | G | 2 | 26 | 0.0023 | KPPVPVAQANLAVRKNINDLTAEE +dK_MMCCH-2 (K) | 433 |
| 34 | 466 | 481 | 1098.4999 | 2194.9852 | 2194.9841 | 0.50 | G | 2 | 32 | 0.00061 | RFQNDKSVDGYQATVE +Deamidated (NQ); dK_MMCCH-2 (K) | 471 |
| 35 | 1117 | 1133 | 1258.0826 | 2514.1507 | 2514.1314 | 7.68 | G | 2 | 17 | 0.021 | HSVPFRVFDYKNNFDYE +dK_MMCCH-2 (K) | 1127 |
| 36 | 1215 | 1235 | 961.8072 | 2882.3997 | 2882.3949 | 1.67 | G | 3 | 40 | 0.0001 | ITQQLHDLDLHVGDNFFLKYE +dK_MMCCH-2 (K) | 1233 |
| 37 | 1292 | 1303 | 879.4671 | 1756.9196 | 1756.9182 | 0.85 | G | 0 | 49 | 1.20E-05 | SIRSAFLQIQKE +dK_MMCCH-2 (K) | 1302 |
| 38 | 1308 | 1320 | 904.9448 | 1807.8751 | 1807.8749 | 0.06 | G | 0 | 28 | 0.0015 | NIAKFHGKPGLCE +dK_MMCCH-2 (K) | 1311 |
| 39 | 1308 | 1320 | 904.9462 | 1807.8778 | 1807.8749 | 1.55 | G | 0 | 35 | 0.00033 | NIAKFHGKPGLCE +dK_MMCCH-2 (K) | 1315 |
| 40 | 1403 | 1422 | 921.4190 | 2761.2350 | 2761.2330 | 0.72 | G | 3 | 23 | 0.0052 | NAVTSRDPQPELWDNKDFYE +dK_MMCCH-2 (K) | 1418 |
| 41 | 1952 | 1967 | 792.6818 | 2375.0236 | 2375.0205 | 1.31 | G | 3 | 31 | 0.00086 | FSKPEDTFDYHRFGYE +dK_MMCCH-2 (K) | 1954 |

Figure 25 continued

| | | | | | | | | | | |
|---|---|---|---|---|---|---|---|---|---|---|
| 42 | 1973 | 1990 | 817.0616 | 2448.1629 | 2448.1454 | 7.15 | G | 0 | 22 | 0.0063 | FVGMSVSSLHNYIKQQQE +dK_MMCCH-2 (K); Oxidation (M) | 1986 |
| 43 | 3386 | 3405 | 658.3166 | 2629.2375 | 2629.2271 | 3.96 | G | 2 | 24 | 0.0038 | LDHAYSLRDGHYIAGPTKD +dK_MMCCH-2 (K) | 3404 |
| 44 | 277 | 296 | 883.7536 | 2648.2390 | 2648.2329 | 2.27 | C | 4 | 41 | 7.80E-05 | DLTREHAKPADSFDYGRLGY +dK_MMCCH-2 (K) | 284 |
| 45 | 629 | 635 | 539.2515 | 1076.4885 | 1076.4848 | 3.44 | C | 0 | 25 | 0.0034 | VGGSEKY +dK_MMCCH-2 (K) | 634 |
| 46 | 1075 | 1080 | 544.7775 | 1087.5404 | 1087.5372 | 2.94 | C | 1 | 34 | 0.0004 | QALQKY +dK_MMCCH-2 (K) | 1079 |
| 47 | 1212 | 1230 | 875.0881 | 2622.2424 | 2622.2424 | -0.04 | C | 4 | 20 | 0.01 | KYEITQQLHDLDLHVGDNF +dK_MMCCH-2 (K) | 1212 |
| 48 | 1298 | 1306 | 715.3740 | 1428.7334 | 1428.7323 | 0.77 | C | 1 | 18 | 0.016 | LQIQKEGIY +dK_MMCCH-2 (K) | 1302 |
| 49 | 1416 | 1421 | 570.2391 | 1138.4637 | 1138.4641 | -0.35 | C | 1 | 16 | 0.022 | DNKDFY +dK_MMCCH-2 (K) | 1418 |
| 50 | 1526 | 1540 | 749.6825 | 2246.0257 | 2246.0215 | 1.87 | C | 2 | 32 | 0.00061 | KHNLPQDSFDYQNRF +dK_MMCCH-2 (K) | 1526 |
| 51 | 1589 | 1606 | 784.3539 | 2350.0400 | 2350.0392 | 0.34 | C | 0 | 19 | 0.011 | ICVEQGGEQNCKTKAGSF +dK_MMCCH-2 (K) | 1602 |
| 52 | 1696 | 1702 | 607.3019 | 1212.5893 | 1212.5849 | 3.63 | C | 1 | 17 | 0.02 | TTLEKHF +dK_MMCCH-2 (K) | 1700 |
| 53 | 1801 | 1809 | 706.8394 | 1411.6643 | 1411.6595 | 3.40 | C | 0 | 14 | 0.043 | SHKTFPNPF +dK_MMCCH-2 (K) | 1803 |
| 54 | 1985 | 1995 | 850.4289 | 1698.8432 | 1698.8399 | 1.94 | C | 0 | 26 | 0.0023 | IKQQQEADRVF +dK_MMCCH-2 (K) | 1986 |
| 55 | 2455 | 2462 | 645.3275 | 1288.6405 | 1288.6373 | 2.48 | C | 1 | 22 | 0.0065 | KYDITQAL +dK_MMCCH-2 (K) | 2455 |
| 56 | 2463 | 2479 | 1128.0192 | 2254.0238 | 2254.0253 | -0.67 | C | 1 | 16 | 0.027 | KAQSIHPEDVFDTDAPF +dK_MMCCH-2 (K) | 2463 |
| 57 | 2865 | 2872 | 673.3657 | 1344.7168 | 1344.7112 | 4.16 | C | 1 | 22 | 0.0067 | RYDITKVL +dK_MMCCH-2 (K) | 2870 |
| 58 | 3235 | 3242 | 617.3148 | 1232.6150 | 1232.6111 | 3.16 | C | 0 | 27 | 0.002 | TSANVKIY +dK_MMCCH-2 (K) | 3240 |
| 59 | 3399 | 3406 | 576.8029 | 1151.5912 | 1151.5896 | 1.30 | C | 0 | 39 | 0.00012 | IAGPTKDL +dK_MMCCH-2 (K) | 3404 |
| 60 | 165 | 175 | 558.6147 | 1672.8224 | 1672.8144 | 4.78 | Th | 1 | 22 | 0.0058 | FEKVQPGHHTR +dK_MMCCH-2 (K) | 167 |
| 61 | 180 | 191 | 909.9202 | 1817.8259 | 1817.8216 | 2.37 | Th | 4 | 65 | 3.30E-07 | ILDALEQDEFCK +dK_MMCCH-2 (K) | 191 |
| 62 | 247 | 260 | 631.6201 | 1891.8385 | 1891.8305 | 4.23 | Th | 2 | 13 | 0.046 | LRGKDPNSADCAHN +dK_MMCCH-2 (K) | 250 |
| 63 | 283 | 293 | 782.8600 | 1563.7054 | 1563.7028 | 1.73 | Th | 3 | 34 | 0.00039 | AKPADSFDYGR +dK_MMCCH-2 (K) | 284 |
| 64 | 364 | 372 | 642.3248 | 1282.6350 | 1282.6301 | 3.82 | Th | 2 | 41 | 7.30E-05 | LLGGPTEMK +dK_MMCCH-2 (K) | 372 |

Figure 25 continued

| | Start | End | Mr(calc) | Mr(expt) | ppm | Enzyme | MC | Score | E value | Peptide | Residue |
|---|---|---|---|---|---|---|---|---|---|---|---|
| 65 | 431 | 437 | 569.2872 | 1136.5599 | 1136.5576 | 2.02 | Th | 1 | 13 | 0.045 | FDKPPVP +dK_MMCCH-2 (K) | 433 |
| 66 | 629 | 636 | 582.7666 | 1163.5186 | 1163.5169 | 1.55 | Th | 1 | 32 | 0.00069 | VGGSEKYS +dK_MMCCH-2 (K) | 634 |
| 67 | 893 | 904 | 904.8990 | 1807.7834 | 1807.7698 | 7.52 | Th | 1 | 25 | 0.0032 | FHGEPKWCPSPE +dK_MMCCH-2 (K) | 898 |
| 68 | 1123 | 1129 | 619.2855 | 1236.5564 | 1236.5485 | 6.39 | Th | 2 | 14 | 0.042 | VFDYKNN +dK_MMCCH-2 (K) | 1127 |
| 69 | 1414 | 1419 | 564.7574 | 1127.5003 | 1127.4957 | 4.08 | Th | 1 | 14 | 0.039 | LWDNKD +dK_MMCCH-2 (K) | 1418 |
| 70 | 1525 | 1539 | 738.3558 | 2212.0457 | 2212.0371 | 3.84 | Th | 3 | 48 | 1.50E-05 | LKHNLPQDSFDYQNR +dK_MMCCH-2 (K) | 1526 |
| 71 | 1589 | 1605 | 735.3320 | 2202.9741 | 2202.9708 | 1.50 | Th | 2 | 22 | 0.0068 | ICVEQGGEQNCKTKAGS +dK_MMCCH-2 (K) | 1600 |
| 72 | 1589 | 1605 | 735.3343 | 2202.9810 | 2202.9708 | 4.68 | Th | 2 | 38 | 0.00016 | ICVEQGGEQNCKTKAGS +dK_MMCCH-2 (K) | 1602 |
| 73 | 1800 | 1809 | 780.3723 | 1558.7301 | 1558.7279 | 1.41 | Th | 2 | 26 | 0.0025 | FSHKTFPNPF +dK_MMCCH-2 (K) | 1803 |
| 74 | 1952 | 1963 | 627.2842 | 1878.8309 | 1878.8247 | 3.30 | Th | 2 | 47 | 1.90E-05 | FSKPEDTFDYHR +dK_MMCCH-2 (K) | 1954 |
| 75 | 1985 | 1994 | 518.2667 | 1551.7783 | 1551.7715 | 4.38 | Th | 2 | 25 | 0.0034 | IKQQQEADRV +dK_MMCCH-2 (K) | 1986 |
| 76 | 2193 | 2199 | 667.3005 | 1332.5864 | 1332.5849 | 1.13 | Th | 2 | 22 | 0.0057 | YWDWTKP +dK_MMCCH-2 (K) | 2198 |
| 77 | 2200 | 2206 | 562.3085 | 1122.6025 | 1122.5995 | 2.67 | Th | 2 | 22 | 0.0057 | ISKLPDL +dK_MMCCH-2 (K) | 2202 |
| 78 | 2225 | 2229 | 462.2214 | 922.4282 | 922.4259 | 2.49 | Th | 2 | 14 | 0.036 | FAKGY +dK_MMCCH-2 (K) | 2227 |
| 79 | 2359 | 2363 | 509.2317 | 1016.4489 | 1016.4460 | 2.95 | Th | 1 | 17 | 0.019 | FTKMH +dK_MMCCH-2 (K); Oxidation (M) | 2361 |
| 80 | 2941 | 2950 | 720.8408 | 1439.6670 | 1439.6602 | 4.72 | Th | 3 | 45 | 2.80E-05 | LDEANDLKNA +dK_MMCCH-2 (K) | 2948 |
| 81 | 3009 | 3015 | 573.2736 | 1144.5327 | 1144.5335 | -0.70 | Th | 0 | 14 | 0.041 | LKEHGSH +dK_MMCCH-2 (K) | 3010 |
| 82 | 3399 | 3405 | 520.2607 | 1038.5069 | 1038.5056 | 1.25 | Th | 1 | 25 | 0.0029 | IAGPTKD +dK_MMCCH-2 (K) | 3404 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide.

The peptide sequences as well as its modifications are listed in "Peptide" column. "Mod_site" indicates the lysine conjugation site for KLH1 or KLH2.

Figure 26

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 124 | 141 | 785.4114 | 2353.2125 | 2353.2001 | 5.27 | T | 1 | 14 | 0.037 | GFTDPPVKHHQSANLLVR +dK_MMCCH-2 (K) | 131 |
| 2 | 142 | 149 | 656.3405 | 1310.6665 | 1310.6653 | 0.92 | T | 1 | 25 | 0.003 | KNINDLTR +dK_MMCCH-2 (K) | 142 |
| 3 | 157 | 166 | 548.9218 | 1643.7436 | 1643.7402 | 2.07 | T | 1 | 20 | 0.011 | EAFHKFQEDR +dK_MMCCH-2 (K) | 161 |
| 4 | 460 | 477 | 781.3956 | 2341.1649 | 2341.1624 | 1.07 | T | 1 | 15 | 0.033 | TSANVDIFIKTTDSVQHK +dK_MMCCH-2 (K) | 469 |
| 5 | 470 | 488 | 748.0444 | 2241.1115 | 2241.1100 | 0.67 | T | 1 | 25 | 0.0034 | TTDSVQHKAGTFAVLGGSK +dK_MMCCH-2 (K) | 477 |
| 6 | 553 | 560 | 663.8661 | 1325.7216 | 1325.7166 | 3.85 | T | 2 | 24 | 0.0041 | VKFDKVPR +dK_MMCCH-2 (K) | 554 |
| 7 | 566 | 570 | 485.2447 | 968.4748 | 968.4749 | -0.10 | T | 1 | 19 | 0.014 | KNVDR +dK_MMCCH-2 (K) | 566 |
| 8 | 581 | 587 | 547.8373 | 1093.6600 | 1093.6569 | 2.83 | T | 1 | 20 | 0.01 | KALALLK +dK_MMCCH-2 (K) | 581 |
| 9 | 588 | 606 | 781.0350 | 2340.0831 | 2340.0845 | -0.60 | T | 1 | 29 | 0.0013 | EDKSAGGFQQLGAFHGEPK +dK_MMCCH-2 (K) | 590 |
| 10 | 645 | 681 | 1158.5393 | 4630.1281 | 4630.1063 | 4.71 | T | 1 | 18 | 0.014 | HGYDGALPYWDWTSPLNHLPELADHEKYVDPEDGVEK +dK_MMCCH-2 (K) | 671 |
| 11 | 682 | 699 | 1239.5804 | 2477.1463 | 2477.1434 | 1.17 | T | 1 | 16 | 0.025 | HNPWFDGHIDTVDKTTTR +dK_MMCCH-2 (K) | 695 |
| 12 | 700 | 719 | 887.7732 | 2660.2977 | 2660.2945 | 1.24 | T | 1 | 44 | 3.70E-05 | SVQNKLFEQPEFGHYTSIAK +dK_MMCCH-2 (K) | 704 |
| 13 | 778 | 789 | 958.0048 | 1913.9950 | 1913.9862 | 4.60 | T | 1 | 31 | 0.00074 | IWAIWQALQKYR +Deamidated (NQ); dK_MMCCH-2 (K) | 787 |
| 14 | 790 | 804 | 669.3164 | 2004.9274 | 2004.9220 | 2.69 | T | 0 | 37 | 0.00019 | GKPYNVANCAVTSMR +dK_MMCCH-2 (K) | 791 |
| 15 | 858 | 863 | 520.2980 | 1038.5814 | 1038.5783 | 2.98 | T | 1 | 17 | 0.019 | KLEAIK +dK_MMCCH-2 (K) | 858 |
| 16 | 953 | 965 | 635.3307 | 1902.9704 | 1902.9662 | 2.21 | T | 1 | 48 | 1.70E-05 | DLFKQPSVIHEPR +dK_MMCCH-2 (K) | 956 |
| 17 | 986 | 1000 | 685.0263 | 2052.0571 | 2052.0561 | 0.49 | T | 1 | 55 | 3.10E-06 | KNIENLSLGELESLR +dK_MMCCH-2 (K) | 986 |
| 18 | 1092 | 1114 | 791.8780 | 3163.4829 | 3163.4682 | 4.62 | T | 1 | 38 | 0.00015 | QHHYETNPFHHGKITHENEITR +dK_MMCCH-2 (K) | 1104 |

| | | | | | | | | |
|---|---|---|---|---|---|---|---|---|
| 19 | 1118 | 1162 | 1414.4275 | 5653.6810 | 5653.6850 | -0.71 | 1 | 28 | 0.0015 | DSLFHSDYFYEQVLYALEQDNFCDFEIQLEILHNALHSLLGGKGK +dK_MMCCH-2 (K) | 1162 |
| 20 | 1199 | 1203 | 353.1912 | 1056.5517 | 1056.5538 | -1.99 | 1 | 17 | 0.019 | KRPYR +dK_MMCCH-2 (K) | 1199 |
| 21 | 1395 | 1403 | 485.5965 | 1453.7677 | 1453.7599 | 5.37 | 2 | 33 | 0.00054 | KDITQLDKR +dK_MMCCH-2 (K) | 1395 |
| 22 | 1473 | 1489 | 778.4053 | 2332.1942 | 2332.1827 | 4.93 | 1 | 45 | 3.10E-05 | KHGAVVGLPYWDWTLPR +dK_MMCCH-2 (K) | 1473 |
| 23 | 1923 | 1932 | 756.3799 | 1510.7452 | 1510.7425 | 1.79 | 1 | 30 | 0.00099 | NKVMPNPFAR +dK_MMCCH 2 (K) | 1924 |
| 24 | 2067 | 2076 | 746.8890 | 1491.7635 | 1491.7544 | 6.10 | 1 | 19 | 0.011 | KHAVPNDVFK +dK_MMCCH-2 (K) | 2067 |
| 25 | 2068 | 2083 | 753.7155 | 2258.1247 | 2258.1194 | 2.35 | 1 | 13 | 0.047 | HAVPNDVFKYELLGYR +dK_MMCCH-2 (K) | 2076 |
| 26 | 2121 | 2149 | 890.4212 | 3557.6557 | 3557.6378 | 5.03 | 1 | 31 | 0.00073 | TSADVQFQICKTSEDCHHGGQIFVLGGTK +dK_MMCCH-2 (K) | 2131 |
| 27 | 2233 | 2251 | 834.0938 | 2499.2596 | 2499.2349 | 9.88 | 2 | 16 | 0.025 | KEINTLTTAEVDNLKDAMR +dK_MMCCH-2 (K) | 2247 |
| 28 | 2299 | 2314 | 715.0192 | 2142.0357 | 2142.0238 | 5.56 | 1 | 14 | 0.037 | LYTKQMEDALTAHGAR +dK_MMCCH-2 (K) | 2302 |
| 29 | 2359 | 2367 | 736.3490 | 1470.6834 | 1470.6813 | 1.43 | 1 | 34 | 0.00038 | DKLFNDPER +dK_MMCCH-2 (K) | 2360 |
| 30 | 2461 | 2490 | 642.8188 | 3850.8691 | 3850.8638 | 1.38 | 1 | 15 | 0.029 | RPLRPFSDPINHNAFTHSNAKPTDVFEYSR +dK_MMCCH-2 (K) | 2481 |
| 31 | 2507 | 2514 | 682.3505 | 1362.6865 | 1362.6853 | 0.88 | 1 | 33 | 0.00053 | KLEHELEK +dK_MMCCH-2 (K) | 2507 |
| 32 | 2515 | 2520 | 571.7624 | 1141.5103 | 1141.5074 | 2.63 | 1 | 22 | 0.0058 | QKEEDR +dK_MMCCH-2 (K) | 2516 |
| 33 | 2621 | 2636 | 802.7112 | 2405.1119 | 2405.1083 | 1.50 | 1 | 47 | 2.00E-05 | HHEKHHEDHHEDILVR +dK_MMCCH-2 (K) | 2624 |
| 34 | 2637 | 2651 | 1069.5295 | 2137.0445 | 2137.0374 | 3.32 | 1 | 59 | 1.40E-06 | KNIHSLSHHEAEELR +dK_MMCCH-2 (K) | 2637 |
| 35 | 2657 | 2686 | 934.9169 | 3735.6384 | 3735.6358 | 0.67 | 1 | 18 | 0.014 | LQNDESHGGYEHIAGFHGYPNLCPEKGDEK +dK_MMCCH-2 (K) | 2686 |
| 36 | 2761 | 2814 | 1328.4335 | 6637.1313 | 6637.0821 | 7.41 | 1 | 17 | 0.022 | DVNEAIFQQTKFGEFSSIFYLALQALEEDNYCDFEVQYEILHNEVHALIGGAEK +4 Deamidated (NQ); dK_MMCCH-1 (K) | 2771 |
| 37 | 2851 | 2883 | 807.5799 | 4032.8631 | 4032.8346 | 7.07 | 0 | 36 | 0.00023 | VKPAHAGSCAGDIMHVPLHPFNYESVNNDDFTR +dK_MMCCH-2 (K) | 2852 |
| 38 | 2897 | 2919 | 1066.5194 | 3196.5364 | 3196.5287 | 2.41 | 1 | 68 | 1.50E-07 | FNYKYDNLNLHGHNIEELEEVLR +dK_MMCCH-2 (K) | 2900 |
| 39 | 3003 | 3021 | 825.7721 | 2474.2944 | 2474.2879 | 2.63 | 1 | 39 | 0.00014 | KYDHTELDASVLPAPIIVR +dK_MMCCH-2 (K) | 3003 |

Figure 26 continued

| # | | | | | | | | | | | |
|---|---|---|---|---|---|---|---|---|---|---|---|
| 40 | 123 | 151 | 616.6594 | 3693.9130 | 3693.9049 | 2.19 | G | 2 | 19 | 0.013 | KGFTDPPVKHHQSANLLVRKNINDLTREE +dK_MMCCH-2 (K) | 123 |
| 41 | 123 | 151 | 739.7917 | 3693.9221 | 3693.9049 | 4.63 | G | 2 | 28 | 0.0015 | KGFTDPPVKHHQSANLLVRKNINDLTREE +dK_MMCCH-2 (K) | 131 |
| 42 | 158 | 176 | 846.3880 | 2536.1422 | 2536.1329 | 3.67 | G | 3 | 27 | 0.002 | AFHKFQEDRSVDGYQATAE +dK_MMCCH-2 (K) | 161 |
| 43 | 526 | 544 | 777.7497 | 2330.2272 | 2330.2304 | -1.37 | G | 1 | 22 | 0.0064 | VDGTKLASSLIPHASVIRE +dK_MMCCH-2 (K) | 530 |
| 44 | 589 | 612 | 990.1168 | 2967.3286 | 2967.3320 | -1.15 | G | 1 | 28 | 0.0015 | DKSAGGFQQLGAFHGEPKWCPSPE +dK_MMCCH-2 (K) | 606 |
| 45 | 825 | 841 | 820.7065 | 2459.0978 | 2459.0780 | 8.05 | G | 1 | 25 | 0.003 | HSVPFNVFDYKTNFNYE +Deamidated (NQ); dK_MMCCH-2 (K) | 835 |
| 46 | 942 | 972 | 764.6027 | 3817.9772 | 3817.9614 | 4.14 | G | 3 | 14 | 0.043 | VFDLKPASLGKDLFKQPSVIHEPRIGHHEGE +dK_MMCCH-2 (K) | 946 |
| 47 | 942 | 970 | 727.3896 | 3631.9116 | 3631.8973 | 3.91 | G | 2 | 16 | 0.024 | VFDLKPASLGKDLFKQPSVIHEPRIGHHE +dK_MMCCH-2 (K) | 956 |
| 48 | 1055 | 1076 | 810.1689 | 3236.6464 | 3236.6402 | 1.92 | G | 1 | 30 | 0.00099 | NALLKKGSSVAVPYWDWTKRIE +2 dK_MMCCH-2 (K) | 1059, 1060 |
| 49 | 1055 | 1076 | 725.6339 | 2898.5063 | 2898.5102 | -1.35 | G | 1 | 41 | 7.10E-05 | NALLKKGSSVAVPYWDWTKRIE +dK_MMCCH-2 (K) | 1060 |
| 50 | 1055 | 1076 | 725.6342 | 2898.5076 | 2898.5102 | -0.90 | G | 1 | 21 | 0.0085 | NALLKKGSSVAVPYWDWTKRIE +dK_MMCCH-2 (K) | 1073 |
| 51 | 1097 | 1110 | 999.9632 | 1997.9118 | 1997.9054 | 3.25 | G | 1 | 18 | 0.016 | TNPFHHGKITHENE +dK_MMCCH-2 (K) | 1104 |
| 52 | 1376 | 1396 | 648.5449 | 2590.1506 | 2590.1428 | 3.01 | G | 3 | 29 | 0.0012 | AGTDSAHTDDGHTEPVMIRKD +dK_MMCCH-2 (K) | 1395 |
| 53 | 1397 | 1413 | 774.4335 | 2320.2786 | 2320.2824 | -1.64 | G | 1 | 25 | 0.0034 | ITQLDKRQQLSLVKALE +dK_MMCCH-2 (K) | 1410 |
| 54 | 1506 | 1522 | 753.3776 | 2257.1110 | 2257.1089 | 0.93 | G | 2 | 26 | 0.0028 | TGRDIPNPFIGSKIEFE +dK_MMCCH-2 (K) | 1518 |
| 55 | 1755 | 1765 | 570.6055 | 1708.7946 | 1708.7913 | 1.93 | G | 2 | 25 | 0.0031 | TLDKMNLRHDE +dK_MMCCH-2 (K) | 1758 |
| 56 | 2089 | 2100 | 854.4103 | 1706.8061 | 1706.8008 | 3.16 | G | 2 | 30 | 0.00094 | IGGMNLHEIEKE +dK_MMCCH-2 (K) | 2099 |
| 57 | 2647 | 2661 | 715.6783 | 2144.0130 | 2144.0095 | 1.63 | G | 4 | 18 | 0.016 | AEELRDALYKLQNDE +dK_MMCCH-2 (K) | 2656 |
| 58 | 3090 | 3097 | 632.8034 | 1263.5923 | 1263.5879 | 3.40 | G | 0 | 16 | 0.026 | LGKMYSVE +dK_MMCCH-2 (K) | 3092 |
| 59 | 59 | 68 | 721.3486 | 1440.6827 | 1440.6781 | 3.19 | C | 1 | 21 | 0.0084 | VLGGPSEMKW +dK_MMCCH-2 (K) | 67 |
| 60 | 94 | 100 | 573.2995 | 1144.5844 | 1144.5838 | 0.52 | C | 1 | 17 | 0.02 | TVKAELF +dK_MMCCH-2 (K) | 96 |
| 61 | 429 | 450 | 990.8052 | 2969.3937 | 2969.3899 | 1.31 | C | 1 | 14 | 0.036 | GGISLENIEKMIHENQQEDRIY +dK_MMCCH-2 (K); Oxidation (M) | 438 |
| 62 | 584 | 595 | 787.4013 | 1572.7879 | 1572.7858 | 1.40 | C | 2 | 46 | 2.60E-05 | ALLKEDKSAGGF +dK_MMCCH-2 (K) | 590 |

Figure 26 continued

| | | | | | | | | | |
|---|---|---|---|---|---|---|---|---|---|
| 63 | 715 | 723 | 655.8741 | 1309.7336 | 1309.7316 | 1.60 | C | 1 | 15 | 0.032 | TSIAKQVLL +dK_MMCCH-2 (K) | 719 |
| 64 | 783 | 788 | 544.7768 | 1087.5390 | 1087.5372 | 1.66 | C | 1 | 23 | 0.0054 | QALQKY +dK_MMCCH-2 (K) | 787 |
| 65 | 830 | 838 | 743.3419 | 1484.6692 | 1484.6646 | 3.10 | C | 2 | 22 | 0.006 | NVFDYKTNF +dK_MMCCH-2 (K) | 835 |
| 66 | 944 | 955 | 821.4310 | 1640.8475 | 1640.8484 | -0.55 | C | 3 | 18 | 0.016 | DLKPASLGKDLF +dK_MMCCH-2 (K) | 946 |
| 67 | 1330 | 1337 | 620.3562 | 1238.6978 | 1238.6944 | 2.74 | C | 1 | 22 | 0.0064 | KLDITKAL +dK_MMCCH-2 (K) | 1335 |
| 68 | 1580 | 1586 | 544.2618 | 1086.5091 | 1086.5056 | 3.22 | C | 0 | 23 | 0.0055 | VGCKEPY +dK_MMCCH-2 (K) | 1583 |
| 69 | 1818 | 1827 | 753.3697 | 1504.7249 | 1504.7232 | 1.20 | C | 1 | 18 | 0.015 | SERDIGSLKY +dK_MMCCH-2 (K) | 1826 |
| 70 | 2076 | 2082 | 612.3051 | 1222.5955 | 1222.5944 | 0.98 | C | 3 | 15 | 0.031 | KYELIGY +dK_MMCCH-2 (K) | 2076 |
| 71 | 2160 | 2184 | 814.3868 | 3253.5180 | 3253.5179 | 0.03 | C | 3 | 14 | 0.036 | KYDITHALHDAHITPEDVFHPSEPF +dK_MMCCH-2 (K) | 2160 |
| 72 | 2476 | 2488 | 923.9227 | 1845.8309 | 1845.8244 | 3.58 | C | 1 | 28 | 0.0017 | THSNAKPTDVFEY +dK_MMCCH-2 (K) | 2481 |
| 73 | 2656 | 2672 | 747.3438 | 2239.0094 | 2239.0004 | 4.02 | C | 2 | 26 | 0.0026 | KLQNDESHGGYEHIAGF +dK_MMCCH-2 (K) | 2656 |
| 74 | 2738 | 2749 | 856.3752 | 1710.7358 | 1710.7348 | 0.58 | C | 2 | 15 | 0.033 | ADSGNNNPFFKY +dK_MMCCH-2 (K) | 2748 |
| 75 | 2946 | 2960 | 965.4056 | 1928.7966 | 1928.7986 | -1.04 | C | 1 | 24 | 0.0044 | IKSGTDSDDEYAGSF +dK_MMCCH-2 (K) | 2947 |
| 76 | 2961 | 2971 | 769.8948 | 1537.7751 | 1537.7673 | 5.07 | C | 1 | 16 | 0.024 | VILGGAKEMPW +dK_MMCCH-2 (K) | 2967 |
| 77 | 1 | 8 | 643.8057 | 1285.5968 | 1285.5934 | 2.64 | Th | 1 | 26 | 0.0026 | MTPEELKT +dK_MMCCH-2 (K) | 7 |
| 78 | 38 | 56 | 861.6823 | 2582.0251 | 2582.0108 | 5.54 | Th | 2 | 17 | 0.022 | VCIPDDNDRNDDHCEKAGD +dK_MMCCH-2 (K) | 53 |
| 79 | 59 | 69 | 785.3758 | 1568.7370 | 1568.7367 | 0.19 | Th | 3 | 59 | 1.40E-06 | VLGGPSEMKWQ +dK_MMCCH-2 (K) | 67 |
| 80 | 78 | 84 | 569.2868 | 1136.5590 | 1136.5536 | 4.75 | Th | 1 | 42 | 6.90E-05 | LSDTVHK +dK_MMCCH-2 (K) | 84 |
| 81 | 117 | 124 | 620.8154 | 1239.6162 | 1239.6070 | 7.34 | Th | 1 | 28 | 0.0016 | VVHHPEKG +dK_MMCCH-2 (K) | 123 |
| 82 | 269 | 282 | 660.0024 | 1976.9855 | 1976.9778 | 3.89 | Th | 4 | 27 | 0.0019 | VIAFEENAPHTKRQ +dK_MMCCH-2 (K) | 280 |
| 83 | 431 | 439 | 707.8527 | 1413.6908 | 1413.6883 | 1.70 | Th | 3 | 42 | 6.60E-05 | ISLENIEKM +dK_MMCCH-2 (K) | 438 |
| 84 | 521 | 530 | 707.8467 | 1413.6788 | 1413.6698 | 6.37 | Th | 2 | 74 | 4.30E-08 | VDITEVDGTK +dK_MMCCH-2 (K) | 530 |
| 85 | 585 | 591 | 585.8110 | 1169.6074 | 1169.6002 | 6.16 | Th | 1 | 35 | 0.00033 | ILKEDKS +dK_MMCCH-2 (K) | 590 |

Figure 26 continued

| # | | | | | | | | | | | |
|---|---|---|---|---|---|---|---|---|---|---|---|
| 86 | 601 | 612 | 904.8955 | 1807.7765 | 1807.7698 | 3.65 | Th | 1 | 21 | 0.0086 | FHGEPKWCPSPE +dK_MMCCH-2 (K) | 606 |
| 87 | 666 | 672 | 607.2842 | 1212.5539 | 1212.5485 | 4.45 | Th | 2 | 23 | 0.0046 | LADHEKY +dK_MMCCH-2 (K) | 671 |
| 88 | 831 | 837 | 612.7877 | 1223.5608 | 1223.5533 | 6.13 | Th | 2 | 17 | 0.019 | VFDYKTN +dK_MMCCH-2 (K) | 835 |
| 89 | 954 | 959 | 529.7660 | 1057.5175 | 1057.5154 | 1.99 | Th | 1 | 16 | 0.027 | LFKQPS +Deamidated (NQ); dK_MMCCH-2 (K) | 956 |
| 90 | 1100 | 1104 | 482.2290 | 962.4434 | 962.4433 | 0.10 | Th | 0 | 16 | 0.023 | FHHGK +dK_MMCCH-2 (K) | 1104 |
| 91 | 1111 | 1120 | 742.3796 | 1482.7446 | 1482.7388 | 3.91 | Th | 1 | 18 | 0.017 | ITTRDPKDSL +dK_MMCCH-2 (K) | 1117 |
| 92 | 1156 | 1164 | 630.8406 | 1259.6666 | 1259.6584 | 6.51 | Th | 2 | 17 | 0.019 | LLGGKGKYS +dK_MMCCH-2 (K) | 1162 |
| 93 | 1219 | 1232 | 980.4258 | 1958.8370 | 1958.8316 | 2.76 | Th | 1 | 58 | 1.60E-06 | FDKSDNNDEATKTH +dK_MMCCH-2 (K) | 1230 |
| 94 | 1580 | 1587 | 572.7747 | 1143.5348 | 1143.5271 | 6.73 | Th | 1 | 14 | 0.043 | VGGKEPYG +dK_MMCCH-2 (K) | 1583 |
| 95 | 1657 | 1668 | 921.9188 | 1841.8231 | 1841.8182 | 2.66 | Th | 2 | 34 | 0.00041 | FSKPEDTFDYQK +dK_MMCCH-2 (K) | 1659 |
| 96 | 1657 | 1668 | 921.9185 | 1841.8225 | 1841.8182 | 2.33 | Th | 2 | 39 | 0.00012 | FSKPEDTFDYQK +dK_MMCCH-2 (K) | 1668 |
| 97 | 1733 | 1741 | 664.3225 | 1326.6305 | 1326.6312 | -0.53 | Th | 2 | 17 | 0.021 | VLGGEKEMP +dK_MMCCH-1 (K); Oxidation (M) | 1738 |
| 98 | 1898 | 1904 | 667.3018 | 1332.5891 | 1332.5849 | 3.15 | Th | 2 | 27 | 0.0021 | YWDWTKP +dK_MMCCH-2 (K) | 1903 |
| 99 | 2064 | 2068 | 499.7606 | 997.5067 | 997.5055 | 1.20 | Th | 0 | 22 | 0.007 | FTKKH +dK_MMCCH-2 (K) | 2067 |
| 100 | 2094 | 2100 | 618.3083 | 1234.6020 | 1234.5903 | 9.48 | Th | 1 | 26 | 0.0023 | LHEIEKE +dK_MMCCH-2 (K) | 2099 |
| 101 | 2129 | 2141 | 622.9256 | 1865.7550 | 1865.7495 | 2.95 | Th | 0 | 24 | 0.0041 | ICKTSEDCHHGGQ +dK_MMCCH-2 (K) | 2131 |
| 102 | 2238 | 2248 | 778.8793 | 1555.7440 | 1555.7440 | 0.00 | Th | 3 | 42 | 6.60E-05 | LTTAEVDNLKD +dK_MMCCH-2 (K) | 2247 |
| 103 | 2480 | 2487 | 622.7983 | 1243.5820 | 1243.5795 | 2.01 | Th | 2 | 20 | 0.0094 | AKPTDVFE +dK_MMCCH-2 (K) | 2481 |
| 104 | 2512 | 2521 | 807.3970 | 1612.7794 | 1612.7766 | 1.67 | Th | 0 | 32 | 0.00061 | LEKQKEEDRT +dK_MMCCH-2 (K) | 2514 |
| 105 | 2595 | 2606 | 806.4030 | 1610.7915 | 1610.7862 | 3.29 | Th | 2 | 34 | 0.00039 | IIDTSGKQLPSD +dK_MMCCH-2 (K) | 2601 |
| 106 | 2607 | 2612 | 520.7797 | 1039.5449 | 1039.5446 | 0.29 | Th | 2 | 19 | 0.014 | IJKMPT +dK_MMCCH-2 (K) | 2609 |
| 107 | 2766 | 2771 | 551.7854 | 1101.5562 | 1101.5529 | 3.09 | Th | 1 | 25 | 0.0029 | IFQQTK +dK_MMCCH-2 (K) | 2771 |
| 108 | 2808 | 2816 | 638.3187 | 1274.6229 | 1274.6217 | 1.02 | Th | 3 | 27 | 0.002 | LIGGAEKYS +dK_MMCCH-2 (K) | 2814 |

Figure 26 continued

| | | | | | | | | | | |
|---|---|---|---|---|---|---|---|---|---|---|
| 109 | 2946 | 2960 | 965.4091 | 1928.8037 | 1928.7986 | 2.64 | Th | 3 | 40 | 9.50E-05 | IKSGTDSDDEYAGSF +dK_MMCCH-2 (K) | 2947 |
| 110 | 2990 | 2996 | 583.2850 | 1164.5555 | 1164.5485 | 6.01 | Th | 1 | 38 | 0.00018 | LTDDHVK +dK_MMCCH-2 (K) | 2996 |
| 111 | 3076 | 3084 | 724.3611 | 1446.7077 | 1446.7040 | 2.63 | Th | 2 | 15 | 0.03 | FKCKVPPFS +dK_MMCCH-2 (K) | 3079 |

Figure 26 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1043.0270 | 2084.0394 | 2084.0347 | 2.26 | T | 1 | 49 | 1.30E-05 | KNVDSLSSDEVLALEK +dK_MMCCH-2 (K) | 26 |
| 2 | 147 | 155 | 694.3710 | 1386.7275 | 1386.7217 | 4.18 | T | 1 | 19 | 0.014 | ADITFLNKK +dK_MMCCH-2 (K) | 155 |
| 3 | 164 | 175 | 596.3106 | 1785.9100 | 1785.8985 | 6.44 | T | 1 | 43 | 5.00E-05 | LFEKVQPGHHTR +dK_MMCCH-2 (K) | 167 |
| 4 | 249 | 271 | 987.4406 | 2959.3000 | 2959.3051 | -1.72 | T | 1 | 30 | 0.001 | GKDPNSADCAHNLIHTPMEPFDR +dK_MMCCH-2 (K) | 250 |
| 5 | 281 | 293 | 610.9454 | 1829.8143 | 1829.8043 | 5.47 | T | 0 | 54 | 3.80E-06 | EHAKPADSFDYGR +dK_MMCCH-2 (K) | 284 |
| 6 | 419 | 446 | 846.4622 | 3381.8195 | 3381.8132 | 1.86 | T | 1 | 27 | 0.0021 | QPTLVHRPAKGHFDKPPVPVAQANLAVR +Deamidated (NQ); dK_MMCCH-2 (K) | 428 |
| 7 | 429 | 446 | 752.0668 | 2253.1785 | 2253.1729 | 2.49 | T | 0 | 41 | 7.30E-05 | GHFDKPPVPVAQANLAVR +dK_MMCCH-2 (K) | 433 |
| 8 | 462 | 466 | 486.7367 | 971.4589 | 971.4568 | 2.16 | T | 1 | 13 | 0.046 | KAMER +dK_MMCCH-2 (K) | 462 |
| 9 | 467 | 488 | 708.5958 | 2830.3539 | 2830.3385 | 5.48 | T | 1 | 69 | 1.10E-07 | FQNDKSVDGYQATVEFHALPAR +dK_MMCCH-2 (K) | 471 |
| 10 | 936 | 950 | 720.3436 | 2158.0089 | 2158.0095 | -0.28 | T | 1 | 34 | 0.00037 | KHGFTGGLPYWDWTR +dK_MMCCH-2 (K) | 936 |
| 11 | 995 | 1052 | 1170.7141 | 7018.2410 | 7018.2306 | 1.48 | T | 1 | 13 | 0.047 | DDLVQSPGFGHYTDIAKQVLLAFEQDDFCDFEVQFEIAHNFIHALVGGNEPYSMS SLR +dK_MMCCH-2 (K) | 1011 |
| 12 | 1082 | 1096 | 996.4616 | 1990.9087 | 1990.9063 | 1.21 | T | 0 | 76 | 2.80E-08 | GKPVNTANCAIASMR +dK_MMCCH-2 (K) | 1083 |
| 13 | 1097 | 1115 | 827.0759 | 2478.2060 | 2478.2101 | -1.65 | T | 0 | 68 | 1.50E-07 | KPLQPFGLDSVINPDDETR +dK_MMCCH-2 (K) | 1097 |
| 14 | 1123 | 1149 | 1190.5593 | 3568.6562 | 3568.6497 | 1.82 | T | 1 | 69 | 1.30E-07 | VFDYKNNFDYEYESLAFNGLSIAQLDR +dK_MMCCH-2 (K) | 1127 |
| 15 | 1355 | 1385 | 1271.2737 | 3810.7992 | 3810.7876 | 3.04 | T | 1 | 49 | 1.30E-05 | GSAVAVPYWDWTEKADSLPSLINDATYFNSR +dK_MMCCH-2 (K) | 1368 |
| 16 | 1409 | 1450 | 1371.8909 | 5483.5344 | 5483.5213 | 2.39 | T | 1 | 50 | 1.00E-05 | DPQPELWDNKDFYENVMLALEQDNFCDFEIQLELIHNALHSR +dK_MMCCH-2 (K) | 1418 |
| 17 | 1455 | 1480 | 1117.8749 | 3350.6028 | 3350.6070 | -1.25 | T | 1 | 69 | 1.40E-07 | AKYSLSLDYTAFDPVFLHHANVDR +dK_MMCCH-2 (K) | 1456 |

Figure 26 continued

| | | | | | | | | | | |
|---|---|---|---|---|---|---|---|---|---|---|
| 18 | 1493 | 1507 | 721.6661 | 2161.9766 | 2161.9594 | 7.91 | T | 1 | 37 | 0.00021 | KKPYNEADCAVNEMR +dK_MMCCH-2 (K) | 1493 |
| 19 | 1493 | 1507 | 721.6617 | 2161.9634 | 2161.9594 | 1.85 | T | 1 | 49 | 1.30E-05 | KKPYNEADCAVNEMR +dK_MMCCH-2 (K) | 1494 |
| 20 | 1508 | 1526 | 837.7523 | 2510.2351 | 2510.2185 | 6.61 | T | 0 | 20 | 0.011 | KPLQPFNNPELNSDSMTLK +dK_MMCCH-2 (K) | 1508 |
| 21 | 1508 | 1539 | 825.9982 | 4124.9545 | 4124.9360 | 4.48 | T | 1 | 24 | 0.0041 | KPLQPFNNPELNSDSMTLKHNLPQDSFDYQNR +dK_MMCCH-2 (K) | 1526 |
| 22 | 1542 | 1564 | 1070.1957 | 3207.5652 | 3207.5448 | 6.39 | T | 1 | 23 | 0.0045 | YQYDNLQFNHFSIQKLDQTIQAR +dK_MMCCH-2 (K) | 1556 |
| 23 | 1690 | 1704 | 532.2902 | 2125.1318 | 2125.1241 | 3.58 | T | 2 | 17 | 0.022 | KEVSSLTTLEKHFLR +dK_MMCCH-2 (K) | 1700 |
| 24 | 1757 | 1768 | 612.9789 | 1835.9150 | 1835.9128 | 1.20 | T | 1 | 14 | 0.041 | LYTVQFEDSLKR +dK_MMCCH-2 (K) | 1767 |
| 25 | 1949 | 1963 | 746.6681 | 2236.9824 | 2236.9735 | 3.98 | T | 0 | 39 | 0.00013 | TQEFSKPEDTFDYHR +dK_MMCCH-2 (K) | 1954 |
| 26 | 2045 | 2052 | 660.3516 | 1318.6887 | 1318.6843 | 3.34 | T | 1 | 21 | 0.0084 | YDITKTLK +dK_MMCCH-2 (K) | 2049 |
| 27 | 2116 | 2125 | 715.3641 | 1428.7136 | 1428.7105 | 2.17 | T | 1 | 21 | 0.0083 | DLASLKSAMR +dK_MMCCH-2 (K) | 2121 |
| 28 | 2218 | 2231 | 937.4800 | 1872.9454 | 1872.9444 | 0.53 | T | 1 | 19 | 0.014 | DAVVNNPFAKGYIK +dK_MMCCH-2 (K) | 2227 |
| 29 | 2228 | 2239 | 870.4218 | 1738.8291 | 1738.8236 | 3.16 | T | 1 | 20 | 0.011 | GYIKSEDAYTVR +dK_MMCCH-2 (K) | 2231 |
| 30 | 2527 | 2541 | 1007.5172 | 2013.0197 | 2013.0088 | 5.41 | T | 1 | 26 | 0.0027 | KDVTSLTASEIENLR +dK_MMCCH-2 (K) | 2527 |
| 31 | 2728 | 2739 | 958.0048 | 1913.9950 | 1913.9862 | 4.60 | T | 1 | 31 | 0.00074 | IWAIWQALQKYR +Deamidated (NQ); dK_MMCCH-2 (K) | 2737 |
| 32 | 2755 | 2764 | 764.3823 | 1526.7500 | 1526.7439 | 4.00 | T | 0 | 33 | 0.00045 | QPLKPFSESR +Deamidated (NQ); dK_MMCCH-2 (K) | 2758 |
| 33 | 2866 | 2873 | 659.3626 | 1316.7107 | 1316.7050 | 4.33 | T | 1 | 15 | 0.029 | YDITKVLK +dK_MMCCH-2 (K) | 2870 |
| 34 | 3148 | 3155 | 629.3355 | 1256.6565 | 1256.6587 | -1.75 | T | 1 | 19 | 0.013 | KKPYNAAK +dK_MMCCH-2 (K) | 3149 |
| 35 | 167 | 178 | 590.9645 | 1769.8716 | 1769.8705 | 0.62 | G | 0 | 36 | 0.00027 | KVQPGHHTRLME +dK_MMCCH-2 (K) | 167 |
| 36 | 433 | 456 | 975.8562 | 2924.5468 | 2924.5429 | 1.30 | G | 2 | 21 | 0.0088 | KPPVPVAQANLAVRKNINDLTAEE +dK_MMCCH-2 (K) | 433 |
| 37 | 466 | 481 | 1098.4998 | 2194.9850 | 2194.9841 | 0.41 | G | 2 | 35 | 0.00032 | RFQNDKSVDGYQATVE +Deamidated (NQ); dK_MMCCH-2 (K) | 471 |
| 38 | 1215 | 1235 | 721.6072 | 2882.3999 | 2882.3949 | 1.70 | G | 3 | 28 | 0.0017 | ITQQLHDLDLHVGDNFFLKYE +dK_MMCCH-2 (K) | 1233 |
| 39 | 1292 | 1303 | 879.4667 | 1756.9189 | 1756.9182 | 0.46 | G | 0 | 49 | 1.20E-05 | SIRSAFLQIQKE +dK_MMCCH-2 (K) | 1302 |
| 40 | 1308 | 1320 | 904.9512 | 1807.8878 | 1807.8749 | 7.08 | G | 0 | 17 | 0.018 | NIAKFHGKPGLCE +dK_MMCCH-2 (K) | 1311 |

Figure 26 continued

| | | | | | | | | | |
|---|---|---|---|---|---|---|---|---|---|
| 41 | 1308 | 1320 | 904.9452 | 1807.8758 | 1807.8749 | 0.50 | G | 0 | 27 | 0.0022 | NIAKFHGKPGLCE +dK_MMCCH-2 (K) | 1315 |
| 42 | 1354 | 1378 | 1043.5070 | 3127.4991 | 3127.4961 | 0.96 | G | 3 | 17 | 0.019 | RGSAVAVPYWDWTEKADSLPSLIND +dK_MMCCH-2 (K) | 1368 |
| 43 | 1403 | 1422 | 921.4236 | 2761.2491 | 2761.2330 | 5.83 | G | 3 | 20 | 0.0092 | NAVTSRDPQPELWDNKDFYE +dK_MMCCH-2 (K) | 1418 |
| 44 | 1952 | 1967 | 792.6805 | 2375.0196 | 2375.0205 | -0.38 | G | 3 | 37 | 0.00021 | FSKPEDTFDYHRFGYE +dK_MMCCH-2 (K) | 1954 |
| 45 | 1973 | 1990 | 817.0591 | 2448.1556 | 2448.1454 | 4.17 | G | 0 | 19 | 0.012 | FVGMSVSSLHNYIKQQQE +dK_MMCCH-2 (K); Oxidation (M) | 1986 |
| 46 | 2477 | 2484 | 644.8365 | 1287.6585 | 1287.6573 | 0.93 | G | 0 | 16 | 0.027 | APfflKVE +dK_MMCCH-2 (K) | 2482 |
| 47 | 3386 | 3405 | 658.3146 | 2629.2292 | 2629.2271 | 0.80 | G | 2 | 25 | 0.0032 | LDHAYSLRDGHYIAGPTKD +dK_MMCCH-2 (K) | 3404 |
| 48 | 152 | 165 | 667.6934 | 2000.0584 | 2000.0513 | 3.55 | C | 2 | 13 | 0.047 | LNKKTSRAVDDRLF +dK_MMCCH-2 (K) | 155 |
| 49 | 166 | 176 | 547.2858 | 1638.8355 | 1638.8300 | 3.30 | C | 0 | 24 | 0.0036 | EKVQPGHHTRL +dK_MMCCH-2 (K) | 167 |
| 50 | 277 | 296 | 883.7568 | 2648.2487 | 2648.2329 | 5.97 | C | 4 | 39 | 0.00014 | DLTREHAKPADSFDYGRLGY +dK_MMCCH-2 (K) | 284 |
| 51 | 364 | 373 | 743.3605 | 1484.7064 | 1484.7044 | 1.35 | C | 2 | 19 | 0.012 | LLGGPTEMKW +dK_MMCCH-2 (K); Oxidation (M) | 372 |
| 52 | 423 | 443 | 872.8013 | 2615.3820 | 2615.3795 | 0.96 | C | 1 | 13 | 0.05 | VHRPAKGHFDKPPVPVAQANL +dK_MMCCH-2 (K) | 428 |
| 53 | 629 | 635 | 539.2519 | 1076.4892 | 1076.4848 | 4.09 | C | 0 | 19 | 0.014 | VGGSEKY +dK_MMCCH-2 (K) | 634 |
| 54 | 1007 | 1015 | 669.8724 | 1337.7302 | 1337.7265 | 2.77 | C | 1 | 30 | 0.0011 | TDIAKQVLL +dK_MMCCH-2 (K) | 1011 |
| 55 | 1075 | 1080 | 544.7768 | 1087.5390 | 1087.5372 | 1.66 | C | 1 | 23 | 0.0054 | QALQKY +dK_MMCCH-2 (K) | 1079 |
| 56 | 1298 | 1306 | 715.3770 | 1428.7395 | 1428.7323 | 5.04 | C | 1 | 14 | 0.041 | LQIQKEGIY +dK_MMCCH-2 (K) | 1302 |
| 57 | 1526 | 1540 | 749.6843 | 2246.0312 | 2246.0215 | 4.32 | C | 2 | 36 | 0.00028 | KHNLPQDSFDYQNRF +dK_MMCCH-2 (K) | 1526 |
| 58 | 1589 | 1606 | 784.3560 | 2350.0461 | 2350.0392 | 2.94 | C | 0 | 24 | 0.0045 | ICVEQGGEQNCKTKAGSF +dK_MMCCH-2 (K) | 1602 |
| 59 | 1696 | 1702 | 607.3021 | 1212.5896 | 1212.5849 | 3.88 | C | 1 | 16 | 0.027 | TTLEKHF +dK_MMCCH-2 (K) | 1700 |
| 60 | 1708 | 1719 | 839.8457 | 1677.6768 | 1677.6651 | 7.03 | C | 0 | 16 | 0.023 | KNMQADDSPDGY +dK_MMCCH-2 (K) | 1708 |
| 61 | 1801 | 1809 | 706.8377 | 1411.6607 | 1411.6595 | 0.92 | C | 0 | 15 | 0.035 | SHKTFPNPF +dK_MMCCH-2 (K) | 1803 |
| 62 | 1985 | 1995 | 850.4290 | 1698.8435 | 1698.8399 | 2.12 | C | 0 | 42 | 6.20E-05 | IKQQQEADRVF +dK_MMCCH-2 (K) | 1986 |
| 63 | 1999 | 2003 | 458.2544 | 914.4942 | 914.4936 | 0.77 | C | 2 | 23 | 0.0046 | LLKGF +dK_MMCCH-2 (K) | 2001 |

Figure 26 continued

| | | | | | | | | | |
|---|---|---|---|---|---|---|---|---|---|
| 64 | 2455 | 2455 | 645.3270 | 1288.6395 | 1288.6373 | 1.71 | C | 1 | 18 | 0.017 | KYDITQAL +dK_MMCCH-2 (K) | 2455 |
| 65 | 2463 | 2462 | 1128.0206 | 2254.0267 | 2254.0253 | 0.67 | C | 1 | 13 | 0.048 | KAQSIHPEDVFDTDAPF +dK_MMCCH-2 (K) | 2463 |
| 66 | 2754 | 2479 | 598.3320 | 1194.6494 | 1194.6471 | 1.93 | C | 1 | 22 | 0.0058 | KQPLKPF +dK_MMCCH-2 (K) | 2754 |
| 67 | 2754 | 2760 | 598.3337 | 1194.6529 | 1194.6471 | 4.85 | C | 1 | 24 | 0.0041 | KQPLKPF +dK_MMCCH-2 (K) | 2758 |
| 68 | 3235 | 3242 | 617.3142 | 1232.6139 | 1232.6111 | 2.27 | C | 0 | 27 | 0.002 | TSANVKIY +dK_MMCCH-2 (K) | 3240 |
| 69 | 165 | 175 | 558.6147 | 1672.8224 | 1672.8144 | 4.78 | Th | 1 | 16 | 0.025 | FEKVQPGHHTR +dK_MMCCH-2 (K) | 167 |
| 70 | 184 | 191 | 703.8036 | 1405.5927 | 1405.5894 | 2.42 | Th | 1 | 33 | 0.00052 | LEQDEFCK +dK_MMCCH-2 (K) | 191 |
| 71 | 247 | 260 | 631.6209 | 1891.8407 | 1891.8305 | 5.39 | Th | 2 | 17 | 0.021 | LRGKDPNSADCAHN +dK_MMCCH-2 (K) | 250 |
| 72 | 283 | 293 | 782.8585 | 1563.7025 | 1563.7028 | -0.19 | Th | 3 | 47 | 2.00E-05 | AKPADSFDYGR +dK_MMCCH-2 (K) | 284 |
| 73 | 365 | 374 | 707.3312 | 1412.6478 | 1412.6469 | 0.71 | Th | 2 | 42 | 6.90E-05 | LGGPTEMKWG +dK_MMCCH-2 (K) | 372 |
| 74 | 467 | 472 | 538.7419 | 1075.4693 | 1075.4644 | 4.56 | Th | 0 | 13 | 0.048 | FQNDKS +dK_MMCCH-2 (K) | 471 |
| 75 | 554 | 565 | 811.8957 | 1621.7768 | 1621.7658 | 6.84 | Th | 1 | 18 | 0.016 | LDPVTGETKNNP +dK_MMCCH-2 (K) | 562 |
| 76 | 629 | 636 | 582.7667 | 1163.5189 | 1163.5169 | 1.72 | Th | 1 | 16 | 0.024 | VGGSEKYS +dK_MMCCH-2 (K) | 634 |
| 77 | 893 | 904 | 904.8955 | 1807.7765 | 1807.7698 | 3.65 | Th | 1 | 21 | 0.0086 | FHGEPKWCPSPE +dK_MMCCH-2 (K) | 898 |
| 78 | 1300 | 1308 | 716.3455 | 1430.6765 | 1430.6751 | 0.91 | Th | 2 | 23 | 0.0048 | IQKEGIYEN +dK_MMCCH-2 (K) | 1302 |
| 79 | 1414 | 1419 | 564.7546 | 1127.4947 | 1127.4957 | -0.89 | Th | 1 | 14 | 0.04 | LWDNKD +dK_MMCCH-2 (K) | 1418 |
| 80 | 1525 | 1539 | 738.3547 | 2212.0422 | 2212.0371 | 2.31 | Th | 3 | 39 | 0.00012 | LKHNLPQDSFDYQNR +dK_MMCCH-2 (K) | 1526 |
| 81 | 1589 | 1605 | 735.3315 | 2202.9726 | 2202.9708 | 0.82 | Th | 2 | 18 | 0.017 | ICVEQGGEQNCKTKAGS +dK_MMCCH-2 (K) | 1600 |
| 82 | 1589 | 1605 | 735.3328 | 2202.9766 | 2202.9708 | 2.68 | Th | 2 | 21 | 0.0076 | ICVEQGGEQNCKTKAGS +dK_MMCCH-2 (K) | 1602 |
| 83 | 1800 | 1809 | 780.3729 | 1558.7313 | 1558.7279 | 2.18 | Th | 2 | 14 | 0.043 | FSHKTFPNPF +dK_MMCCH-2 (K) | 1803 |
| 84 | 1952 | 1963 | 627.2849 | 1878.8327 | 1878.8247 | 4.26 | Th | 2 | 48 | 1.70E-05 | FSKPEDTFDYHR +dK_MMCCH-2 (K) | 1954 |
| 85 | 1985 | 1994 | 776.8962 | 1551.7778 | 1551.7715 | 4.06 | Th | 2 | 28 | 0.0015 | IKQQQEADRV +dK_MMCCH-2 (K) | 1986 |
| 86 | 2193 | 2199 | 667.3018 | 1332.5891 | 1332.5849 | 3.15 | Th | 2 | 27 | 0.0021 | YWDWTKP +dK_MMCCH-2 (K) | 2198 |

Figure 26 continued

| 87 | 2200 | 2206 | 562.3079 | 1122.6012 | 1122.5995 | 1.51 | 2 | 19 | 0.013 | ISKLPDL +dK_MMCCH-2 (K) | 2202 |
| 88 | 2225 | 2229 | 462.2217 | 922.4289 | 922.4259 | 3.36 | 2 | 22 | 0.0056 | FAKGY +dK_MMCCH-2 (K) | 2227 |
| 89 | 2230 | 2237 | 632.7946 | 1263.5747 | 1263.5693 | 4.27 | 2 | 18 | 0.016 | IKSEDAYT +dK_MMCCH-2 (K) | 2231 |
| 90 | 2804 | 2815 | 937.4586 | 1872.9026 | 1872.9073 | -2.51 | 2 | 15 | 0.034 | AMLQERKKEERT +Deamidated (NQ); dK_MMCCH-2 (K); Oxidation (M) | 2811 |
| 91 | 2941 | 2950 | 720.8405 | 1439.6663 | 1439.6602 | 4.24 | 3 | 49 | 1.30E-05 | LDEANDLKNA +dK_MMCCH-2 (K) | 2948 |
| 92 | 3009 | 3015 | 573.2770 | 1144.5395 | 1144.5335 | 5.24 | 0 | 16 | 0.023 | LKEHGSH +dK_MMCCH-2 (K) | 3010 |
| 93 | 3399 | 3405 | 520.2615 | 1038.5085 | 1038.5056 | 2.79 | 1 | 28 | 0.0015 | IAGPTKD +dK_MMCCH-2 (K) | 3404 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the lysine conjugation site for KLH1 or KLH2.

Figure 26 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 124 | 141 | 785.4103 | 2353.2092 | 2353.2001 | 3.87 | T | 1 | 17 | 0.02 | GFTDPPVKHHQSANILVR +dK_MMCCH-2 (K) | 131 |
| 2 | 142 | 149 | 656.3403 | 1310.6661 | 1310.6653 | 0.69 | T | 1 | 29 | 0.0013 | KNINDLTR +dK_MMCCH-2 (K) | 142 |
| 3 | 157 | 166 | 823.3675 | 1644.7204 | 1644.7242 | -2.31 | T | 1 | 24 | 0.0038 | EAFHKFQEDR +Deamidated (NQ); dK_MMCCH-2 (K) | 161 |
| 4 | 184 | 192 | 726.8430 | 1451.6715 | 1451.6649 | 4.48 | T | 1 | 26 | 0.0026 | CPRPDAKDR +dK_MMCCH-2 (K) | 190 |
| 5 | 553 | 560 | 663.8685 | 1325.7224 | 1325.7166 | 4.37 | T | 2 | 26 | 0.0026 | VKFDKVPR +dK_MMCCH-2 (K) | 554 |
| 6 | 566 | 570 | 485.2447 | 968.4748 | 968.4749 | -0.21 | T | 1 | 19 | 0.014 | KNVDR +dK_MMCCH-2 (K) | 566 |
| 7 | 581 | 587 | 547.8374 | 1093.6602 | 1093.6569 | 3.02 | T | 1 | 18 | 0.018 | KALALLK +dK_MMCCH-2 (K) | 581 |
| 8 | 588 | 606 | 781.0366 | 2340.0879 | 2340.0845 | 1.45 | T | 1 | 14 | 0.036 | EDKSAGGFQQLGAFHGEPK +dK_MMCCH-2 (K) | 590 |
| 9 | 645 | 681 | 1158.5381 | 4630.1233 | 4630.1063 | 3.65 | T | 1 | 18 | 0.015 | HGYDGALPYWDWTSPLNHLPELADHEKYVDPEDGVEK +dK_MMCCH-2 (K) | 671 |
| 10 | 682 | 699 | 620.2961 | 2477.1555 | 2477.1434 | 4.84 | T | 1 | 21 | 0.0075 | HNPWFDGHIDTVDKTTTR +dK_MMCCH-2 (K) | 695 |
| 11 | 700 | 719 | 887.7724 | 2660.2954 | 2660.2945 | 0.34 | T | 1 | 20 | 0.01 | SVQNKLFEQPEFGHYTSIAK +dK_MMCCH-2 (K) | 704 |
| 12 | 778 | 789 | 957.9997 | 1913.9848 | 1913.9862 | -0.68 | T | 1 | 39 | 0.00012 | IWAIWQALQKYR +Deamidated (NQ); dK_MMCCH-2 (K) | 787 |
| 13 | 790 | 804 | 1003.4713 | 2004.9281 | 2004.9220 | 3.04 | T | 0 | 48 | 1.60E-05 | GKPYNVANCAVTSMR +dK_MMCCH-2 (K) | 791 |
| 14 | 858 | 863 | 520.2989 | 1038.5832 | 1038.5783 | 4.72 | T | 1 | 17 | 0.022 | KLEAIK +dK_MMCCH-2 (K) | 858 |
| 15 | 916 | 924 | 740.8735 | 1479.7324 | 1479.7319 | 0.27 | T | 1 | 16 | 0.025 | VFKYDITEK +dK_MMCCH-2 (K) | 918 |
| 16 | 953 | 965 | 635.3304 | 1902.9693 | 1902.9662 | 1.63 | T | 1 | 43 | 5.20E-05 | DLFKQPSVIHEPR +dK_MMCCH-2 (K) | 956 |
| 17 | 986 | 1000 | 1027.0363 | 2052.0579 | 2052.0561 | 0.93 | T | 1 | 66 | 2.50E-07 | KNIENLSLGELESLR +dK_MMCCH-2 (K) | 986 |
| 18 | 1092 | 1114 | 791.8748 | 3163.4699 | 3163.4682 | 0.54 | T | 1 | 41 | 8.30E-05 | QHHYETNPFHHGKITHENEITTR +dK_MMCCH-2 (K) | 1104 |

Figure 27

| | | | | | | | | | |
|---|---|---|---|---|---|---|---|---|---|
| 19 | 1118 | 1162 | 1414.4266 | 5653.6775 | 5653.6850 | -1.34 | 1 | 1 | 23 | 0.0049 | DSLFHSDYFYEQVLYALEQDNFCDFFEIQLEILHNALHSLLGGKGK +dK_MMCCH-2 (K) | 1162 |
| 20 | 1199 | 1203 | 353.1902 | 1056.5487 | 1056.5538 | -4.83 | 1 | 1 | 17 | 0.02 | KRPYR +dK_MMCCH-2 (K) | 1199 |
| 21 | 1395 | 1403 | 727.8865 | 1453.7585 | 1453.7599 | -0.96 | 1 | 2 | 30 | 0.00092 | KDITQLDKR +dK_MMCCH-2 (K) | 1395 |
| 22 | 1395 | 1403 | 598.3055 | 1791.8946 | 1791.8899 | 2.62 | 1 | 2 | 15 | 0.031 | KDITQLDKR +2 dK_MMCCH-2 (K) | 1395, 1402 |
| 23 | 1417 | 1445 | 1125.2129 | 3372.6168 | 3372.6020 | 4.42 | 1 | 1 | 16 | 0.024 | ADMSSDGFQAIASFHALPPLCPSPAASKR +dK_MMCCH-2 (K) | 1444 |
| 24 | 1473 | 1489 | 778.4003 | 2332.1790 | 2332.1827 | -1.59 | 1 | 1 | 46 | 2.60E-05 | KHGAVVGLPVWDWTLPR +dK_MMCCH-2 (K) | 1473 |
| 25 | 1747 | 1758 | 613.9767 | 1838.9082 | 1838.9012 | 3.81 | 1 | 1 | 21 | 0.0084 | LYKYDITETLDK +dK_MMCCH-2 (K) | 1749 |
| 26 | 1923 | 1932 | 756.3794 | 1510.7442 | 1510.7425 | 1.19 | 1 | 1 | 28 | 0.0016 | NKVMPNPFAR +dK_MMCCH-2 (K) | 1924 |
| 27 | 2100 | 2109 | 492.2465 | 1964.9570 | 1964.9601 | -1.58 | 1 | 2 | 20 | 0.0094 | EIKDKQHHVYR +2 dK_MMCCH-2 (K) | 2102, 2104 |
| 28 | 2121 | 2149 | 890.4189 | 3557.6464 | 3557.6378 | 2.42 | 1 | 1 | 40 | 9.10E-05 | TSADVQFQICKTSEDCHHGGQIFVLGGTK +dK_MMCCH-2 (K) | 2131 |
| 29 | 2299 | 2314 | 715.0167 | 2142.0283 | 2142.0238 | 2.15 | 1 | 1 | 32 | 0.00069 | LYTKQMEDALTAHGAR +dK_MMCCH-2 (K) | 2302 |
| 30 | 2359 | 2367 | 736.3491 | 1470.6836 | 1470.6813 | 1.56 | 1 | 1 | 35 | 0.00031 | DKLFNDPER +dK_MMCCH-2 (K) | 2360 |
| 31 | 2507 | 2514 | 682.3539 | 1362.6932 | 1362.6853 | 5.80 | 1 | 1 | 40 | 0.0001 | KLEHELEK +dK_MMCCH-2 (K) | 2507 |
| 32 | 2515 | 2520 | 571.7606 | 1141.5066 | 1141.5074 | -0.70 | 1 | 1 | 21 | 0.0086 | QKEEDR +dK_MMCCH-2 (K) | 2516 |
| 33 | 2595 | 2609 | 983.5358 | 1965.0571 | 1965.0493 | 4.02 | 1 | 1 | 15 | 0.035 | IIDTSGKQLPSDLJK +dK_MMCCH-2 (K) | 2601 |
| 34 | 2621 | 2636 | 802.7097 | 2405.1073 | 2405.1083 | -0.42 | 1 | 1 | 51 | 8.60E-06 | HHEKHHEDHHEDILVR +dK_MMCCH-2 (K) | 2624 |
| 35 | 2637 | 2651 | 1069.5260 | 2137.0374 | 2137.0374 | 0.00 | 1 | 1 | 74 | 4.00E-08 | KNIHSLSHHEAEELR +dK_MMCCH-2 (K) | 2637 |
| 36 | 2761 | 2814 | 1324.8440 | 6619.1836 | 6619.1192 | 9.73 | 1 | 1 | 16 | 0.023 | DVNEAIFQQTKFGEFSSIFYLALQALEEDNYCDFEVQYEILHNEVHALIGGAEK +dK_MMCCH-2 (K) | 2771 |
| 37 | 2851 | 2883 | 1009.2193 | 4032.8481 | 4032.8346 | 3.35 | 1 | 0 | 51 | 7.20E-06 | VKPAHAGSCAGDIMHVPLHPFNYESVNNDDFTR +dK_MMCCH-2 (K) | 2852 |
| 38 | 2897 | 2919 | 1066.5216 | 3196.5430 | 3196.5287 | 4.47 | 1 | 1 | 75 | 3.50E-08 | FNYKYDNLNLHGHNIEELEEVLR +dK_MMCCH-2 (K) | 2900 |
| 39 | 2938 | 2947 | 730.4158 | 1458.8170 | 1458.8156 | 0.96 | 1 | 1 | 17 | 0.02 | TTAVVKVYIK +dK_MMCCH-2 (K) | 2943 |

Figure 27 continued

| | | | | | | | | | | | | |
|---|---|---|---|---|---|---|---|---|---|---|---|---|
| 40 | 3003 | 3021 | 825.7742 | 2474.3007 | 2474.2879 | 5.17 | T | 1 | 39 | 0.00013 | KYDHTELDASVLPAPIIVR +dK_MMCCH-2 (K) | 3003 |
| 41 | 123 | 151 | 616.6595 | 3693.9132 | 3693.9049 | 2.25 | G | 2 | 21 | 0.0073 | KGFTDPPVKHHQSANLLVRKNINDLTREE +dK_MMCCH-2 (K) | 123 |
| 42 | 123 | 151 | 673.0134 | 4032.0366 | 4032.0350 | 0.40 | G | 2 | 16 | 0.023 | KGFTDPPVKHHQSANLLVRKNINDLTREE +2 dK_MMCCH-2 (K) | 123, 142 |
| 43 | 123 | 151 | 739.7915 | 3693.9211 | 3693.9049 | 4.39 | G | 2 | 22 | 0.0063 | KGFTDPPVKHHQSANLLVRKNINDLTREE +dK_MMCCH-2 (K) | 131 |
| 44 | 158 | 176 | 846.3875 | 2536.1407 | 2536.1329 | 3.08 | G | 3 | 19 | 0.011 | AFHKFQEDRSVDGYQATAE +dK_MMCCH-2 (K) | 161 |
| 45 | 435 | 442 | 676.3240 | 1350.6335 | 1350.6312 | 1.78 | C | 1 | 26 | 0.0026 | NIEKMIHE +dK_MMCCH-2 (K) | 438 |
| 46 | 526 | 544 | 777.7499 | 2330.2280 | 2330.2304 | -1.03 | G | 1 | 27 | 0.00021 | VDGTKLASSLIPHASVIRE +dK_MMCCH-2 (K) | 530 |
| 47 | 589 | 612 | 990.1188 | 2967.3345 | 2967.3320 | 0.84 | G | 1 | 16 | 0.024 | DKSAGGFQQLGAFHGEPKWCPSPE +dK_MMCCH-2 (K) | 606 |
| 48 | 825 | 841 | 820.3725 | 2458.0957 | 2458.0940 | 0.69 | G | 1 | 38 | 0.00015 | HSVPFNVFDYKTNFNYE +dK_MMCCH-2 (K) | 835 |
| 49 | 847 | 860 | 965.0152 | 1928.0158 | 1928.0077 | 4.20 | G | 0 | 23 | 0.005 | FNGLSISQLNKKLE +dK_MMCCH-2 (K) | 858 |
| 50 | 1055 | 1076 | 810.1688 | 3236.6462 | 3236.6402 | 1.82 | G | 1 | 24 | 0.0041 | NALLKKGSSVAVPYWDWTKRIE +2 dK_MMCCH-2 (K) | 1059, 1060 |
| 51 | 1055 | 1076 | 725.6330 | 2898.5029 | 2898.5102 | -2.52 | G | 1 | 37 | 0.00021 | NALLKKGSSVAVPYWDWTKRIE +dK_MMCCH-2 (K) | 1060 |
| 52 | 1097 | 1110 | 999.9601 | 1997.9057 | 1997.9054 | 0.15 | G | 1 | 23 | 0.0052 | TNPFHHGKITHENE +dK_MMCCH-2 (K) | 1104 |
| 53 | 1376 | 1396 | 864.3901 | 2590.1484 | 2590.1428 | 2.16 | G | 3 | 20 | 0.011 | AGTDSAHTDDGHTEPVMIRKD +dK_MMCCH-2 (K) | 1395 |
| 54 | 1397 | 1413 | 665.6099 | 2658.4103 | 2658.4125 | -0.79 | G | 1 | 13 | 0.046 | ITQLDKRQQLSLVKALE +2 dK_MMCCH-2 (K) | 1402, 1410 |
| 55 | 1397 | 1413 | 774.4366 | 2320.2879 | 2320.2824 | 2.37 | G | 1 | 22 | 0.0064 | ITQLDKRQQLSLVKALE +dK_MMCCH-2 (K) | 1410 |
| 56 | 1495 | 1522 | 866.6912 | 3462.7358 | 3462.7381 | -0.66 | G | 3 | 21 | 0.0086 | LLTVSTIHDPETGRDIPNPFIGSKIEFE +dK_MMCCH-2 (K) | 1518 |
| 57 | 1755 | 1765 | 570.6042 | 1708.7909 | 1708.7913 | -0.18 | G | 2 | 27 | 0.002 | TLDKMNLRHDE +dK_MMCCH-2 (K) | 1758 |
| 58 | 2089 | 2100 | 854.4125 | 1706.8104 | 1706.8008 | 5.68 | G | 2 | 20 | 0.011 | IGGMNLHEIEKE +dK_MMCCH-2 (K) | 2099 |
| 59 | 2647 | 2661 | 715.6751 | 2144.0035 | 2144.0095 | -2.80 | G | 4 | 35 | 0.00035 | AEELRDALYKLQNDE +dK_MMCCH-2 (K) | 2656 |
| 60 | 3090 | 3097 | 632.8023 | 1263.5901 | 1263.5879 | 1.66 | G | 0 | 15 | 0.029 | LGKMYSVE +dK_MMCCH-2 (K) | 3092 |
| 61 | 59 | 68 | 729.3450 | 1456.6755 | 1456.6731 | 1.65 | C | 1 | 17 | 0.022 | VLGGPSEMKW +dK_MMCCH-2 (K); Oxidation (M) | 67 |
| 62 | 94 | 100 | 573.2991 | 1144.5836 | 1144.5838 | -0.17 | C | 1 | 20 | 0.011 | TVKAELF +dK_MMCCH-2 (K) | 96 |

Figure 27 continued

| | | | | | | | | | | |
|---|---|---|---|---|---|---|---|---|---|---|
| 63 | 160 | 171 | 606.9445 | 1817.8116 | 1817.8043 | 4.02 | C | 1 | 17 | 0.021 | HKFQEDRSVDGY +dK_MMCCH-2 (K) | 161 |
| 64 | 587 | 595 | 638.7999 | 1275.5852 | 1275.5805 | 3.68 | C | 0 | 31 | 0.00081 | KEDKSAGGF +dK_MMCCH-2 (K) | 590 |
| 65 | 715 | 723 | 655.8767 | 1309.7387 | 1309.7316 | 5.50 | C | 1 | 20 | 0.0094 | TSIAKQVLL +dK_MMCCH-2 (K) | 719 |
| 66 | 783 | 788 | 544.7763 | 1087.5381 | 1087.5372 | 0.83 | C | 1 | 22 | 0.0067 | QALQKY +dK_MMCCH-2 (K) | 787 |
| 67 | 918 | 928 | 856.9330 | 1711.8515 | 1711.8491 | 1.40 | C | 2 | 14 | 0.038 | KYDITEKLHDL +dK_MMCCH-2 (K) | 924 |
| 68 | 1330 | 1337 | 620.3548 | 1238.6050 | 1238.6044 | 0.48 | C | 1 | 24 | 0.004 | KLDITKAL +dK_MMCCH-2 (K) | 1335 |
| 69 | 1431 | 1446 | 696.3564 | 2086.0473 | 2086.0492 | -0.91 | C | 1 | 13 | 0.045 | HALPPLCPSPAASKRF +dK_MMCCH-2 (K) | 1444 |
| 70 | 1580 | 1586 | 544.2603 | 1086.5061 | 1086.5056 | 0.46 | C | 0 | 13 | 0.046 | VGGKEPY +dK_MMCCH-2 (K) | 1583 |
| 71 | 1649 | 1664 | 752.3298 | 2253.9675 | 2253.9637 | 1.69 | C | 2 | 14 | 0.044 | NLNDHTHDFSKPEDTF +dK_MMCCH-2 (K) | 1659 |
| 72 | 1818 | 1827 | 753.3687 | 1504.7227 | 1504.7232 | -0.27 | C | 1 | 22 | 0.0061 | SERDIGSLKY +dK_MMCCH-2 (K) | 1826 |
| 73 | 2476 | 2488 | 923.9230 | 1845.8315 | 1845.8244 | 3.90 | C | 1 | 22 | 0.0061 | THSNAKPTDVFEY +dK_MMCCH-2 (K) | 2481 |
| 74 | 2656 | 2666 | 793.3514 | 1584.6882 | 1584.6879 | 0.25 | C | 1 | 32 | 0.00057 | KLQNDESHGGY +dK_MMCCH-2 (K) | 2656 |
| 75 | 2738 | 2749 | 856.3745 | 1710.7343 | 1710.7348 | -0.29 | C | 2 | 19 | 0.013 | ADSGNNNPFFKY +dK_MMCCH-2 (K) | 2748 |
| 76 | 2946 | 2960 | 965.4053 | 1928.7960 | 1928.7986 | -1.35 | C | 1 | 23 | 0.0053 | IKSGTDSDDEYAGSF +dK_MMCCH-2 (K) | 2947 |
| 77 | 2961 | 2971 | 769.8909 | 1537.7673 | 1537.7673 | 0.00 | C | 1 | 19 | 0.013 | VILGGAKEMPW +dK_MMCCH-2 (K) | 2967 |
| 78 | 1 | 9 | 725.3376 | 1448.6606 | 1448.6567 | 2.69 | Th | 2 | 25 | 0.0032 | MTPEELKTY +dK_MMCCH-2 (K) | 7 |
| 79 | 38 | 56 | 861.6801 | 2582.0183 | 2582.0108 | 2.90 | Th | 2 | 15 | 0.03 | VCIPDDNDRNDDHCEKAGD +dK_MMCCH-2 (K) | 53 |
| 80 | 59 | 69 | 785.3757 | 1568.7368 | 1568.7367 | 0.06 | Th | 3 | 58 | 1.70E-06 | VLGGPSEMKWQ +dK_MMCCH-2 (K) | 67 |
| 81 | 78 | 84 | 569.2871 | 1136.5595 | 1136.5536 | 5.19 | Th | 1 | 50 | 9.20E-06 | LSDTVHK +dK_MMCCH-2 (K) | 84 |
| 82 | 118 | 124 | 571.2781 | 1140.5417 | 1140.5386 | 2.72 | Th | 0 | 23 | 0.0046 | VHHPEKG +dK_MMCCH-2 (K) | 123 |
| 83 | 431 | 439 | 707.8519 | 1413.6893 | 1413.6883 | 0.71 | Th | 3 | 24 | 0.004 | ISLENIEKM +dK_MMCCH-2 (K) | 438 |
| 84 | 521 | 531 | 764.3844 | 1526.7542 | 1526.7538 | 0.26 | Th | 3 | 44 | 3.60E-05 | VDITEVDGTKL +dK_MMCCH-2 (K) | 530 |
| 85 | 585 | 591 | 585.8102 | 1169.6058 | 1169.6002 | 4.79 | Th | 1 | 35 | 0.00031 | LLKEDKS +dK_MMCCH-2 (K) | 590 |

Figure 27 continued

| | | | | | | | | | | |
|---|---|---|---|---|---|---|---|---|---|---|
| 86 | 601 | 612 | 904.8973 | 1807.7801 | 1807.7698 | 5.70 | Th | 1 | 18 | 0.018 | FHGEPKWCPSPE +dK_MMCCH-2 (K) | 606 |
| 87 | 666 | 672 | 607.2836 | 1212.5526 | 1212.5485 | 3.38 | Th | 2 | 23 | 0.0045 | LADHEKY +dK_MMCCH-2 (K) | 671 |
| 88 | 673 | 685 | 930.4165 | 1858.8184 | 1858.8196 | -0.65 | Th | 2 | 14 | 0.044 | VDPEDGVEKHNPW +dK_MMCCH-2 (K) | 681 |
| 89 | 831 | 837 | 612.7872 | 1223.5598 | 1223.5533 | 5.31 | Th | 2 | 26 | 0.0023 | VFDYKTN +dK_MMCCH-2 (K) | 835 |
| 90 | 1156 | 1164 | 630.8394 | 1259.6642 | 1259.6584 | 4.60 | Th | 2 | 15 | 0.028 | LLGGKGKYS +dK_MMCCH-2 (K) | 1162 |
| 91 | 1210 | 1232 | 766.6633 | 2296.9682 | 2296.9617 | 2.83 | Th | 1 | 17 | 0.02 | FDKSDNNDEATKTH +2 dK_MMCCH-2 (K) | 1221, 1230 |
| 92 | 1219 | 1232 | 653.9531 | 1958.8376 | 1958.8316 | 3.01 | Th | 1 | 26 | 0.0024 | FDKSDNNDEATKTH +dK_MMCCH-2 (K) | 1230 |
| 93 | 1580 | 1587 | 572.7737 | 1143.5329 | 1143.5271 | 5.16 | Th | 1 | 18 | 0.016 | VGGKEPYG +dK_MMCCH-2 (K) | 1583 |
| 94 | 1657 | 1668 | 921.9181 | 1841.8216 | 1841.8182 | 1.85 | Th | 2 | 34 | 0.00042 | FSKPEDTFDYQK +dK_MMCCH-2 (K) | 1659 |
| 95 | 1657 | 1668 | 921.9170 | 1841.8194 | 1841.8182 | 0.65 | Th | 2 | 45 | 3.20E-05 | FSKPEDTFDYQK +dK_MMCCH-2 (K) | 1668 |
| 96 | 1733 | 1741 | 664.3219 | 1326.6292 | 1326.6312 | -1.43 | Th | 2 | 17 | 0.019 | VLGGEKEMP +dK_MMCCH-1 (K); Oxidation (M) | 1738 |
| 97 | 1894 | 1904 | 850.4162 | 1698.8178 | 1698.8116 | 3.65 | Th | 2 | 36 | 0.00024 | VAVPVWDWTKP +dK_MMCCH-2 (K) | 1903 |
| 98 | 2064 | 2068 | 499.7590 | 997.5035 | 997.5055 | -2.01 | Th | 5 | 20 | 0.0095 | FTKKH +dK_MMCCH-2 (K) | 2067 |
| 99 | 2094 | 2100 | 618.3051 | 1234.5957 | 1234.5903 | 4.29 | Th | 0 | 29 | 0.0013 | LHEIEKE +dK_MMCCH-2 (K) | 2099 |
| 100 | 2129 | 2141 | 622.9244 | 1865.7515 | 1865.7495 | 1.07 | Th | 1 | 26 | 0.0026 | ICKTSEDCHHGGQ +dK_MMCCH-2 (K) | 2131 |
| 101 | 2238 | 2249 | 814.3990 | 1626.7835 | 1626.7811 | 1.54 | Th | 0 | 45 | 3.40E-05 | LTTAEVDNLKDA +dK_MMCCH-2 (K) | 2247 |
| 102 | 2512 | 2521 | 807.3978 | 1612.7810 | 1612.7766 | 2.67 | Th | 4 | 25 | 0.0035 | LEKQKEEDRT +dK_MMCCH-2 (K) | 2514 |
| 103 | 2595 | 2606 | 806.4025 | 1610.7904 | 1610.7862 | 2.61 | Th | 0 | 31 | 0.00079 | IIDTSGKQLPSD +dK_MMCCH-2 (K) | 2601 |
| 104 | 2607 | 2612 | 520.7792 | 1039.5439 | 1039.5446 | -0.67 | Th | 2 | 26 | 0.0027 | LIKMPT +dK_MMCCH-2 (K) | 2609 |
| 105 | 2766 | 2771 | 551.7890 | 1101.5634 | 1101.5529 | 9.62 | Th | 2 | 29 | 0.0013 | IFQQTK +dK_MMCCH-2 (K) | 2771 |
| 106 | 2808 | 2816 | 638.3207 | 1274.6268 | 1274.6217 | 4.08 | Th | 1 | 27 | 0.0018 | LIGGAEKYS +dK_MMCCH-2 (K) | 2814 |
| 107 | 2946 | 2960 | 965.4059 | 1928.7972 | 1928.7986 | -0.73 | Th | 3 | 37 | 0.0002 | IKSGTDSDDEYAGSF +dK_MMCCH-2 (K) | 2947 |
| 108 | 2990 | 2996 | 583.2842 | 1164.5538 | 1164.5485 | 4.55 | Th | 1 | 38 | 0.00017 | LTDDHVK +dK_MMCCH-2 (K) | 2996 |

Figure 27 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1043.0210 | 2084.0274 | 2084.0347 | -3.50 | T | 1 | 32 | 0.00066 | KNVDSLSSDEVLALEK +dK_MMCCH-2 (K) | 26 |
| 2 | 147 | 155 | 694.3692 | 1386.7238 | 1386.7217 | 1.51 | T | 1 | 15 | 0.031 | ADITFLNKK +dK_MMCCH-2 (K) | 155 |
| 3 | 164 | 175 | 596.3080 | 1785.9023 | 1785.8985 | 2.13 | T | 1 | 33 | 0.00048 | LFEKVQPGHHTR +dK_MMCCH-2 (K) | 167 |
| 4 | 249 | 271 | 987.4402 | 2959.2989 | 2959.3051 | -2.10 | T | 1 | 39 | 0.00012 | GKDPNSADCAHNLIHTPMEPFDR +dK_MMCCH-2 (K) | 250 |
| 5 | 281 | 293 | 610.9460 | 1829.8163 | 1829.8043 | 6.56 | T | 0 | 55 | 3.40E-06 | EHAKPADSFDYGR +dK_MMCCH-2 (K) | 284 |
| 6 | 359 | 377 | 849.4008 | 2545.1806 | 2545.1810 | -0.16 | T | 1 | 14 | 0.041 | AGDFFLLGGPTEMKWGFYR +dK_MMCCH-2 (K); Oxidation (M) | 372 |
| 7 | 429 | 446 | 752.0674 | 2253.1805 | 2253.1729 | 3.37 | T | 0 | 52 | 6.60E-06 | GHFDKPPVPVAQANLAVR +dK_MMCCH-2 (K) | 433 |
| 8 | 467 | 488 | 708.5944 | 2830.3483 | 2830.3385 | 3.50 | T | 1 | 65 | 2.90E-07 | FQNDKSVDGYQATVEFHALPAR +dK_MMCCH-2 (K) | 471 |
| 9 | 489 | 497 | 726.8430 | 1451.6715 | 1451.6649 | 4.48 | T | 1 | 26 | 0.0026 | CPRPDAKDR +dK_MMCCH-2 (K) | 495 |
| 10 | 936 | 950 | 1080.0154 | 2158.0162 | 2158.0095 | 3.10 | T | 1 | 43 | 5.40E-05 | KHGFTGGLPYWDWTR +dK_MMCCH-2 (K) | 936 |
| 11 | 1082 | 1096 | 996.4625 | 1990.9104 | 1990.9063 | 2.06 | T | 0 | 38 | 0.00014 | GKPYNTANCAIASMR +dK_MMCCH-2 (K) | 1083 |
| 12 | 1097 | 1115 | 827.0796 | 2478.2169 | 2478.2101 | 2.78 | T | 0 | 65 | 3.10E-07 | KPLQPFGLDSVINPDDETR +dK_MMCCH-2 (K) | 1097 |
| 13 | 1123 | 1149 | 1190.5587 | 3568.6543 | 3568.6497 | 1.32 | T | 1 | 70 | 1.10E-07 | VFDYKNNFDYEYESLAFNGLSIAQLDR +dK_MMCCH-2 (K) | 1127 |
| 14 | 1355 | 1385 | 1271.2697 | 3810.7871 | 3810.7876 | -0.10 | T | 1 | 27 | 0.0018 | GSAVAVPYWDWTEKADSLPSLINDATYFNSR +dK_MMCCH-2 (K) | 1368 |
| 15 | 1409 | 1450 | 1097.7139 | 5483.5330 | 5483.5213 | 2.13 | T | 1 | 37 | 0.00018 | DPQPELWDNKDFYENVMLALEQDNFCDFEIQLELIHNALHSR +dK_MMCCH-2 (K) | 1418 |
| 16 | 1455 | 1480 | 838.6586 | 3350.6054 | 3350.6070 | -0.48 | T | 1 | 54 | 3.80E-06 | AKYSLSSLDYTAFDPVFFLHHANVDR +dK_MMCCH-2 (K) | 1456 |
| 17 | 1493 | 1507 | 721.6621 | 2161.9645 | 2161.9594 | 2.36 | T | 1 | 48 | 1.60E-05 | KKPYNEADCAVNEMR +dK_MMCCH-2 (K) | 1494 |
| 18 | 1542 | 1564 | 1070.1956 | 3207.5649 | 3207.5448 | 6.27 | T | 1 | 22 | 0.0058 | YQYDNLQFNHFSIQKLDQTIQAR +dK_MMCCH-2 (K) | 1556 |
| 19 | 1690 | 1704 | 709.3851 | 2125.1334 | 2125.1241 | 4.33 | T | 2 | 16 | 0.026 | KEVSSLTTILEKHFLR +dK_MMCCH-2 (K) | 1700 |

Figure 27 continued

| | | | | | | | | |
|---|---|---|---|---|---|---|---|---|
| 20 | 1757 | 1768 | 612.9798 | 1835.9176 | 1835.9128 | 2.61 | T | 1 | 1 | 14 | 0.043 | LYTVQFEDSLKR +dK_MMCCH-2 (K) | 1767 |
| 21 | 1804 | 1825 | 945.4659 | 2833.3760 | 2833.3633 | 4.48 | T | 1 | 1 | 14 | 0.044 | TFPNPFLKANIEFEGEGVTTER +dK_MMCCH-2 (K) | 1811 |
| 22 | 1949 | 1963 | 560.2521 | 2236.9795 | 2236.9735 | 2.64 | T | 0 | 0 | 55 | 2.90E-06 | TQEFSKPEDTFDYHR +dK_MMCCH-2 (K) | 1954 |
| 23 | 2045 | 2052 | 660.3509 | 1318.6872 | 1318.6843 | 2.27 | T | 1 | 1 | 15 | 0.034 | YDITKTLK +dK_MMCCH-2 (K) | 2049 |
| 24 | 2228 | 2239 | 870.4226 | 1738.8307 | 1738.8236 | 4.08 | T | 1 | 1 | 14 | 0.038 | GYIKSEDAYTVR +dK_MMCCH-2 (K) | 2231 |
| 25 | 2453 | 2463 | 839.9299 | 1677.8452 | 1677.8436 | 0.95 | T | 1 | 1 | 13 | 0.048 | NFKYDITQALK +dK_MMCCH-2 (K) | 2455 |
| 26 | 2527 | 2541 | 1007.5138 | 2013.0130 | 2013.0088 | 2.09 | T | 1 | 1 | 66 | 2.80E-07 | KDVTSLTASEIENLR +dK_MMCCH-2 (K) | 2527 |
| 27 | 2728 | 2739 | 957.9997 | 1913.9848 | 1913.9862 | -0.68 | T | 1 | 1 | 39 | 0.00012 | IWAIWQALQKYR +Deamidated (NQ); dK_MMCCH-2 (K) | 2737 |
| 28 | 2755 | 2764 | 764.3805 | 1526.7464 | 1526.7439 | 1.64 | T | 0 | 0 | 33 | 0.00054 | QPLKPFSESR +Deamidated (NQ); dK_MMCCH-2 (K) | 2758 |
| 29 | 2866 | 2873 | 659.3614 | 1316.7083 | 1316.7050 | 2.51 | T | 1 | 1 | 18 | 0.016 | YDITKVLK +dK_MMCCH-2 (K) | 2870 |
| 30 | 3148 | 3155 | 629.3343 | 1256.6541 | 1256.6587 | -3.58 | T | 1 | 1 | 16 | 0.028 | KKPYNAAK +dK_MMCCH-2 (K) | 3149 |
| 31 | 167 | 178 | 590.9642 | 1769.8707 | 1769.8705 | 0.11 | T | 0 | 0 | 27 | 0.0018 | KVQPGHHTRLME +dK_MMCCH-2 (K) | 167 |
| 32 | 466 | 481 | 1098.4980 | 2194.9815 | 2194.9841 | -1.18 | G | 2 | 2 | 24 | 0.0036 | RFQNDKSVDGYQATVE +Deamidated (NQ); dK_MMCCH-2 (K) | 471 |
| 33 | 1215 | 1235 | 721.6050 | 2882.3908 | 2882.3949 | -1.42 | G | 3 | 3 | 36 | 0.00026 | ITQQLHDLDLHVGDNFFLKYE +dK_MMCCH-2 (K) | 1233 |
| 34 | 1292 | 1303 | 879.4659 | 1756.9172 | 1756.9182 | -0.57 | G | 0 | 0 | 36 | 0.00028 | SIRSAFLQIQKE +dK_MMCCH-2 (K) | 1302 |
| 35 | 1308 | 1320 | 904.9471 | 1807.8796 | 1807.8749 | 2.60 | G | 0 | 0 | 29 | 0.0014 | NIAKFHGKPGLCE +dK_MMCCH-2 (K) | 1315 |
| 36 | 1403 | 1422 | 921.4155 | 2761.2248 | 2761.2330 | -2.97 | G | 3 | 3 | 23 | 0.0054 | NAVTSRDPQPELWDNKDFYE +dK_MMCCH-2 (K) | 1418 |
| 37 | 1952 | 1967 | 792.6802 | 2375.0189 | 2375.0205 | -0.67 | G | 3 | 3 | 30 | 0.00092 | FSKPEDTFDYHRFGYE +dK_MMCCH-2 (K) | 1954 |
| 38 | 1973 | 1990 | 811.7284 | 2432.1635 | 2432.1505 | 5.39 | G | 0 | 0 | 21 | 0.008 | FVGMSVSSLHNYIKQQQE +dK_MMCCH-2 (K) | 1986 |
| 39 | 2477 | 2484 | 644.8361 | 1287.6576 | 1287.6573 | 0.16 | G | 0 | 0 | 25 | 0.003 | APFFIKVE +dK_MMCCH-2 (K) | 2482 |
| 40 | 3007 | 3011 | 477.7571 | 953.4996 | 953.5004 | -0.84 | G | 0 | 0 | 13 | 0.045 | RALKE +dK_MMCCH-2 (K) | 3010 |
| 41 | 3386 | 3405 | 658.3147 | 2629.2297 | 2629.2271 | 0.99 | G | 2 | 2 | 30 | 0.00091 | LDHAYSLRDGHYIAGPTKD +dK_MMCCH-2 (K) | 3404 |
| 42 | 277 | 296 | 883.7569 | 2648.2489 | 2648.2329 | 6.00 | C | 4 | 4 | 32 | 0.00056 | DLTREHAKPADSFDYGRLGY +dK_MMCCH-2 (K) | 284 |

Figure 27 continued

| | | | | | | | | | |
|---|---|---|---|---|---|---|---|---|---|
| 43 | 364 | 373 | 743.3618 | 1484.7091 | 1484.7044 | 3.17 | C | 2 | 13 | 0.047 | LLGGPTEMKW +dK_MMCCH-2 (K); Oxidation (M) | 372 |
| 44 | 432 | 443 | 793.9156 | 1585.8166 | 1585.8174 | -0.50 | C | 0 | 18 | 0.018 | DKPPVPVAQANL +dK_MMCCH-2 (K) | 433 |
| 45 | 629 | 635 | 539.2512 | 1076.4878 | 1076.4848 | 2.69 | C | 0 | 13 | 0.048 | VGGSEKY +dK_MMCCH-2 (K) | 634 |
| 46 | 1075 | 1080 | 544.7763 | 1087.5381 | 1087.5372 | 0.83 | C | 1 | 22 | 0.0067 | QALQKY +dK_MMCCH-2 (K) | 1079 |
| 47 | 1212 | 1230 | 875.0863 | 2622.2371 | 2622.2424 | -2.06 | C | 4 | 14 | 0.04 | KYEITQQLHDLDLHVGDNF +dK_MMCCH-2 (K) | 1212 |
| 48 | 1416 | 1421 | 570.2397 | 1138.4648 | 1138.4641 | 0.61 | C | 1 | 17 | 0.018 | DNKDTY +dK_MMCCH-2 (K) | 1418 |
| 49 | 1589 | 1606 | 784.3536 | 2350.0391 | 2350.0392 | -0.04 | C | 0 | 20 | 0.01 | ICVEQGGEQNCKTKAGSF +dK_MMCCH-2 (K) | 1602 |
| 50 | 1696 | 1702 | 607.3007 | 1212.5869 | 1212.5849 | 1.65 | C | 1 | 21 | 0.0086 | TTLEKHF +dK_MMCCH-2 (K) | 1700 |
| 51 | 1708 | 1719 | 839.8414 | 1677.6683 | 1677.6651 | 1.91 | C | 0 | 22 | 0.007 | KNMQADDSPDGY +dK_MMCCH-2 (K) | 1708 |
| 52 | 1782 | 1796 | 1014.5062 | 2026.9978 | 2026.9921 | 2.76 | C | 1 | 25 | 0.0029 | KPQSALPDLVTQETY +dK_MMCCH-2 (K) | 1782 |
| 53 | 1801 | 1809 | 706.8369 | 1411.6591 | 1411.6595 | -0.21 | C | 0 | 28 | 0.0017 | SHKTFPNPF +dK_MMCCH-2 (K) | 1803 |
| 54 | 1982 | 1995 | 705.3458 | 2113.0155 | 2113.0051 | 4.92 | C | 1 | 25 | 0.0031 | HNYIKQQQEADRVF +dK_MMCCH-2 (K) | 1986 |
| 55 | 1999 | 2003 | 458.2542 | 914.4939 | 914.4936 | 0.44 | C | 2 | 26 | 0.0027 | LLKGF +dK_MMCCH-2 (K) | 2001 |
| 56 | 2455 | 2462 | 645.3264 | 1288.6381 | 1288.6373 | 0.62 | C | 1 | 18 | 0.017 | KYDITQAL +dK_MMCCH-2 (K) | 2455 |
| 57 | 2463 | 2479 | 1128.0186 | 2254.0225 | 2254.0253 | -1.20 | C | 1 | 20 | 0.011 | KAQSIHPEDVFDTDAPF +dK_MMCCH-2 (K) | 2463 |
| 58 | 2754 | 2760 | 598.3323 | 1194.6501 | 1194.6471 | 2.51 | C | 1 | 23 | 0.0045 | KQPLKPF +dK_MMCCH-2 (K) | 2758 |
| 59 | 2865 | 2872 | 673.3627 | 1344.7108 | 1344.7112 | -0.30 | C | 1 | 18 | 0.014 | RYDITKVL +dK_MMCCH-2 (K) | 2870 |
| 60 | 3235 | 3242 | 617.3138 | 1232.6130 | 1232.6111 | 1.54 | C | 0 | 19 | 0.012 | TSANVKIY +dK_MMCCH-2 (K) | 3240 |
| 61 | 3399 | 3406 | 576.8050 | 1151.5954 | 1151.5896 | 5.04 | C | 0 | 17 | 0.022 | IAGPTKDL +dK_MMCCH-2 (K) | 3404 |
| 62 | 184 | 191 | 703.8036 | 1405.5926 | 1405.5894 | 2.28 | Th | 1 | 41 | 8.60E-05 | LEQDEFCK +dK_MMCCH-2 (K) | 191 |
| 63 | 247 | 260 | 631.6191 | 1891.8356 | 1891.8305 | 2.70 | Th | 2 | 15 | 0.033 | LRGKDPNSADCAHN +dK_MMCCH-2 (K) | 250 |
| 64 | 283 | 293 | 782.8574 | 1563.7002 | 1563.7028 | -1.66 | Th | 3 | 32 | 0.00071 | AKPADSFDYGR +dK_MMCCH-2 (K) | 284 |
| 65 | 365 | 372 | 585.7805 | 1169.5464 | 1169.5461 | 0.26 | Th | 1 | 40 | 9.60E-05 | LGGPTEMK +dK_MMCCH-2 (K) | 372 |

Figure 27 continued

| | | | | | | | | | | | | |
|---|---|---|---|---|---|---|---|---|---|---|---|---|
| 66 | 467 | 472 | 538.7411 | 1075.4677 | 1075.4644 | 3.07 | Th | 0 | 13 | 0.049 | FQNDKS +dK_MMCCH-2 (K) | 471 |
| 67 | 629 | 636 | 582.7668 | 1163.5191 | 1163.5169 | 1.98 | Th | 1 | 21 | 0.0074 | VGGSEKYS +dK_MMCCH-2 (K) | 634 |
| 68 | 893 | 904 | 904.8973 | 1807.7801 | 1807.7698 | 5.70 | Th | 1 | 18 | 0.018 | FHGEPKWCPSPE +dK_MMCCH-2 (K) | 898 |
| 69 | 1300 | 1308 | 716.3438 | 1430.6731 | 1430.6751 | -1.47 | Th | 2 | 14 | 0.044 | IQKEGIYEN +dK_MMCCH-2 (K) | 1302 |
| 70 | 1414 | 1419 | 564.7560 | 1127.4975 | 1127.4957 | 1.60 | Th | 1 | 21 | 0.0077 | LWDNKD +dK_MMCCH-2 (K) | 1418 |
| 71 | 1525 | 1539 | 738.3560 | 2212.0461 | 2212.0371 | 4.02 | Th | 3 | 40 | 9.70E-05 | LKHNLPQDSFDYQNR +dK_MMCCH-2 (K) | 1526 |
| 72 | 1589 | 1605 | 735.3304 | 2202.9695 | 2202.9708 | -0.59 | Th | 2 | 15 | 0.03 | ICVEQGGEQNCKTKAGS +dK_MMCCH-2 (K) | 1600 |
| 73 | 1589 | 1605 | 735.3321 | 2202.9744 | 2202.9708 | 1.68 | Th | 2 | 38 | 0.00016 | ICVEQGGEQNCKTKAGS +dK_MMCCH-2 (K) | 1602 |
| 74 | 1800 | 1809 | 780.3717 | 1558.7288 | 1558.7279 | 0.64 | Th | 2 | 16 | 0.026 | FSHKTFPNPF +dK_MMCCH-2 (K) | 1803 |
| 75 | 1952 | 1963 | 627.2838 | 1878.8294 | 1878.8247 | 2.50 | Th | 2 | 52 | 6.20E-06 | FSKPEDTFDYHR +dK_MMCCH-2 (K) | 1954 |
| 76 | 1985 | 1994 | 776.8953 | 1551.7760 | 1551.7715 | 2.90 | Th | 2 | 24 | 0.0038 | IKQQQEADRV +dK_MMCCH-2 (K) | 1986 |
| 77 | 2193 | 2199 | 667.3006 | 1332.5866 | 1332.5849 | 1.28 | Th | 2 | 27 | 0.002 | YWDWTKP +dK_MMCCH-2 (K) | 2198 |
| 78 | 2200 | 2206 | 562.3071 | 1122.5997 | 1122.5995 | 0.18 | Th | 2 | 19 | 0.014 | ISKLPDL +dK_MMCCH-2 (K) | 2202 |
| 79 | 2225 | 2229 | 462.2212 | 922.4278 | 922.4259 | 2.06 | Th | 2 | 22 | 0.0067 | FAKGY +dK_MMCCH-2 (K) | 2227 |
| 80 | 2230 | 2237 | 632.7943 | 1263.5739 | 1263.5693 | 3.72 | Th | 2 | 18 | 0.016 | IKSEDAYT +dK_MMCCH-2 (K) | 2231 |
| 81 | 2359 | 2363 | 509.2319 | 1016.4492 | 1016.4460 | 3.25 | Th | 1 | 21 | 0.0082 | FTKMH +dK_MMCCH-2 (K); Oxidation (M) | 2361 |
| 82 | 2941 | 2950 | 720.8395 | 1439.6645 | 1439.6602 | 2.99 | Th | 3 | 46 | 2.80E-05 | LDFANDLKNA +dK_MMCCH-2 (K) | 2948 |
| 83 | 3009 | 3015 | 573.2736 | 1144.5326 | 1144.5335 | -0.87 | Th | 0 | 17 | 0.02 | LKEHGSH +dK_MMCCH-2 (K) | 3010 |
| 84 | 3399 | 3405 | 520.2613 | 1038.5080 | 1038.5056 | 2.31 | Th | 1 | 27 | 0.0022 | IAGPTKD +dK_MMCCH-2 (K) | 3404 |

Figure 27 continued

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage.

Figure 27 continued

Scores are the peptide ion score directly reported from Mascot database search engine. E value denotes the expectation value for each identified peptide. The peptide sequences as well as its modifications are listed in "Peptide" column. "Mod_site" indicates the lysine conjugation site for KLH1 or KLH2.

Figure 28

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 124 | 141 | 589.3078 | 2353.2020 | 2353.2001 | 0.81 | T | 1 | 27 | 0.0018 | GFTDPPVKHHQSANLLVR +dK_MMCCH-2 (K) | 131 |
| 2 | 142 | 149 | 656.3417 | 1310.6689 | 1310.6653 | 2.82 | T | 1 | 26 | 0.0026 | KNINDLTR +dK_MMCCH-2 (K) | 142 |
| 3 | 157 | 166 | 822.8806 | 1643.7467 | 1643.7402 | 3.95 | T | 1 | 18 | 0.015 | EAFHKFQEDR +dK_MMCCH-2 (K) | 161 |
| 4 | 252 | 281 | 735.7524 | 3673.7255 | 3673.7008 | 6.72 | T | 1 | 20 | 0.011 | TYVDSHGASHTNPFHSSVIAFENAPHTKR +dK_MMCCH-2 (K) | 280 |
| 5 | 460 | 477 | 781.3948 | 2341.1625 | 2341.1624 | 0.04 | T | 1 | 29 | 0.0012 | TSANVDFIKTTDSVQHK +dK_MMCCH-2 (K) | 469 |
| 6 | 470 | 488 | 748.0457 | 2241.1153 | 2241.1100 | 2.36 | T | 1 | 41 | 7.70E-05 | TTDSVQHKAGTFAVLGGSK +dK_MMCCH-2 (K) | 477 |
| 7 | 553 | 560 | 663.8673 | 1325.7201 | 1325.7166 | 2.64 | T | 2 | 21 | 0.0076 | VKFDKVPR +dK_MMCCH-2 (K) | 554 |
| 8 | 553 | 560 | 442.9153 | 1325.7240 | 1325.7166 | 5.58 | T | 2 | 15 | 0.033 | VKFDKVPR +dK_MMCCH-2 (K) | 557 |
| 9 | 566 | 570 | 485.2460 | 968.4774 | 968.4749 | 2.48 | T | 1 | 15 | 0.029 | KNVDR +dK_MMCCH-2 (K) | 566 |
| 10 | 581 | 587 | 547.8371 | 1093.6596 | 1093.6569 | 2.47 | T | 1 | 29 | 0.0014 | KALALLK +dK_MMCCH-2 (K) | 581 |
| 11 | 588 | 606 | 781.0346 | 2340.0820 | 2340.0845 | -1.07 | T | 1 | 29 | 0.0014 | EDKSAGGFQQLGAFHGEPK +dK_MMCCH-2 (K) | 590 |
| 12 | 591 | 615 | 1004.4717 | 3010.3934 | 3010.3742 | 6.38 | T | 1 | 18 | 0.017 | SAGGFQQLGAFHGEPKWCPSPEASK +dK_MMCCH-2 (K) | 606 |
| 13 | 645 | 681 | 1544.3801 | 4630.1186 | 4630.1063 | 2.63 | T | 1 | 27 | 0.0021 | HGYDGALPYWDWTSPLNHLPELADHEKYVDPEDGVEK +dK_MMCCH-2 (K) | 671 |
| 14 | 682 | 699 | 620.2958 | 2477.1540 | 2477.1434 | 4.28 | T | 1 | 26 | 0.0027 | HNPWFDGHIDTVDKTTTR +dK_MMCCH-2 (K) | 695 |
| 15 | 700 | 719 | 887.7726 | 2660.2959 | 2660.2945 | 0.53 | T | 1 | 51 | 8.60E-06 | SVQNKLFEQPEFGHYTSIAK +dK_MMCCH-2 (K) | 704 |
| 16 | 790 | 804 | 669.3168 | 2004.9287 | 2004.9220 | 3.34 | T | 0 | 35 | 0.0003 | GKPYNVANCAVTSMR +dK_MMCCH-2 (K) | 791 |
| 17 | 805 | 835 | 777.1814 | 3880.8706 | 3880.8771 | -1.67 | T | 1 | 14 | 0.044 | EPLQPFGLSANINTDHVTKEHSVPFNVFDYK +dK_MMCCH-2 (K) | 823 |
| 18 | 858 | 863 | 520.2996 | 1038.5846 | 1038.5783 | 5.97 | T | 1 | 13 | 0.046 | KLEAIK +dK_MMCCH-2 (K) | 858 |

| | | | | | | | | | | | | |
|---|---|---|---|---|---|---|---|---|---|---|---|---|
| 19 | 879 | 884 | 500.2816 | 998.5487 | 998.5470 | 1.60 | T | 1 | 14 | 0.042 | KSSLVK+dK_MMCCH-2 (K) | 879 |
| 20 | 953 | 965 | 635.3298 | 1902.9677 | 1902.9662 | 0.79 | T | 1 | 42 | 6.50E-05 | DLFKQPSVIHEPR+dK_MMCCH-2 (K) | 956 |
| 21 | 986 | 1000 | 1027.0387 | 2052.0628 | 2052.0561 | 3.31 | T | 1 | 77 | 2.20E-08 | KNIENLSLGELESLR+dK_MMCCH-2 (K) | 986 |
| 22 | 1048 | 1060 | 609.3545 | 1825.0416 | 1825.0423 | -0.38 | T | 1 | 36 | 0.00025 | LYVVVENALLKK+dK_MMCCH-2 (K) | 1060 |
| 23 | 1092 | 1114 | 791.8781 | 3163.4831 | 3163.4682 | 4.71 | T | 1 | 34 | 0.00041 | QHHYETNPFHHGKITHENEJTTR+dK_MMCCH-2 (K) | 1104 |
| 24 | 1199 | 1203 | 353.1910 | 1056.5512 | 1056.5538 | -2.46 | T | 1 | 17 | 0.019 | KRPYR+dK_MMCCH-2 (K) | 1199 |
| 25 | 1331 | 1338 | 620.3541 | 1238.6937 | 1238.6944 | -0.57 | T | 1 | 18 | 0.014 | LDITKALK+dK_MMCCH-2 (K) | 1335 |
| 26 | 1395 | 1403 | 598.3055 | 1791.8948 | 1791.8899 | 2.73 | T | 2 | 17 | 0.021 | KDITQLDKR+2 dK_MMCCH-2 (K) | 1395, 1402 |
| 27 | 1395 | 1403 | 485.5956 | 1453.7648 | 1453.7599 | 3.37 | T | 2 | 17 | 0.019 | KDITQLDKR+dK_MMCCH-2 (K) | 1402 |
| 28 | 1417 | 1445 | 1125.2156 | 3372.6249 | 3372.6020 | 6.82 | T | 1 | 30 | 0.00092 | ADHSSDGFQAIASFHALPPLCPSPAASKR+dK_MMCCH-2 (K) | 1444 |
| 29 | 1473 | 1489 | 778.4014 | 2332.1823 | 2332.1827 | -0.17 | T | 1 | 42 | 6.00E-05 | KHGAVVGLPYWDWTLPR+dK_MMCCH-2 (K) | 1473 |
| 30 | 1721 | 1746 | 1087.4750 | 3259.4031 | 3259.3937 | 2.88 | T | 1 | 34 | 0.00042 | TAGDCEDAGYFTVLGGEKEMPWAFDR+dK_MMCCH-2 (K) | 1738 |
| 31 | 1890 | 1922 | 879.8322 | 4394.1247 | 4394.1048 | 4.53 | T | 1 | 14 | 0.043 | HGSSVAVPYVWDWTKPIHNIPHLFTDKEYYDVWR+dK_MMCCH-2 (K) | 1915 |
| 32 | 1923 | 1932 | 756.3802 | 1510.7458 | 1510.7425 | 2.25 | T | 1 | 25 | 0.0032 | NKVMPNPFAR+dK_MMCCH-2 (K) | 1924 |
| 33 | 2067 | 2076 | 746.8856 | 1491.7567 | 1491.7544 | 1.54 | T | 1 | 25 | 0.0032 | KHAVPNDVFK+dK_MMCCH-2 (K) | 2067 |
| 34 | 2068 | 2083 | 753.7166 | 2258.1280 | 2258.1194 | 3.81 | T | 1 | 14 | 0.041 | HAVPNDVFKYELLGYR+dK_MMCCH-2 (K) | 2076 |
| 35 | 2100 | 2109 | 492.2479 | 1964.9626 | 1964.9601 | 1.27 | T | 2 | 22 | 0.0068 | EIKDKQHHVR+2 dK_MMCCH-2 (K) | 2102, 2104 |
| 36 | 2121 | 2149 | 890.4148 | 3557.6301 | 3557.6378 | -2.19 | T | 1 | 34 | 0.00036 | TSADVQFQJCKTSEDCHHGGQIFVLGGTK+dK_MMCCH-2 (K) | 2131 |
| 37 | 2359 | 2367 | 736.3485 | 1470.6825 | 1470.6813 | 0.82 | T | 1 | 32 | 0.00068 | DKLFNDPER+dK_MMCCH-2 (K) | 2360 |
| 38 | 2461 | 2490 | 642.8189 | 3850.8694 | 3850.8638 | 1.45 | T | 1 | 16 | 0.024 | RPLRPFSDPINHNAFTHSNAKPTDVFEYSR+dK_MMCCH-2 (K) | 2481 |
| 39 | 2507 | 2514 | 682.3526 | 1362.6906 | 1362.6853 | 3.89 | T | 1 | 33 | 0.00049 | KLEHELEK+dK_MMCCH-2 (K) | 2507 |
| 40 | 2508 | 2516 | 746.3801 | 1490.7457 | 1490.7439 | 1.21 | T | 1 | 21 | 0.0082 | LEHELEKQK+dK_MMCCH-2 (K) | 2516 |
| 41 | 2595 | 2609 | 983.5291 | 1965.0437 | 1965.0493 | -2.85 | T | 1 | 18 | 0.018 | IIDTSGKQLPSDLIK+dK_MMCCH-2 (K) | 2601 |

Figure 28 continued

| | | | | | | | | | | |
|---|---|---|---|---|---|---|---|---|---|---|
| 42 | 2621 | 2636 | 802.7109 | 2405.1110 | 2405.1083 | 1.12 | T | 1 | 48 | 1.80E-05 | HHEKHHEDHHHEDILVR +dK_MMCCH-2 (K) | 2624 |
| 43 | 2637 | 2651 | 713.3541 | 2137.0406 | 2137.0374 | 1.45 | T | 1 | 61 | 7.40E-07 | KNIHSLSHHEAEELR +dK_MMCCH-2 (K) | 2637 |
| 44 | 2657 | 2686 | 1246.2177 | 3735.6311 | 3735.6358 | -1.26 | T | 1 | 16 | 0.028 | LQNDESHGGYEHIAGFHGYPNLCPEKGDEK +dK_MMCCH-2 (K) | 2686 |
| 45 | 2714 | 2748 | 1087.7693 | 4347.0481 | 4347.0524 | -1.01 | T | 1 | 47 | 1.80E-05 | KHGSHLGIPYWDWTQTISSLPTFFADSGNNNPFFK +dK_MMCCH-2 (K) | 2714 |
| 46 | 2851 | 2883 | 1009.2180 | 4032.8430 | 4032.8346 | 2.08 | T | 1 | 74 | 4.20E-08 | VKPAHAGSCAGDIMHVPLHPFNYESVNNDDFTR +dK_MMCCH-2 (K) | 2852 |
| 47 | 2897 | 2919 | 1066.5209 | 3196.5408 | 3196.5287 | 3.79 | T | 0 | 50 | 1.00E-05 | FNYKYDNLNLHGHNIEELEEVLR +dK_MMCCH-2 (K) | 2900 |
| 48 | 2938 | 2947 | 730.4150 | 1458.8154 | 1458.8156 | -0.14 | T | 1 | 22 | 0.0064 | TTAVVKVYIK +dK_MMCCH-2 (K) | 2943 |
| 49 | 3003 | 3021 | 825.7742 | 2474.3007 | 2474.2879 | 5.17 | T | 1 | 54 | 3.90E-06 | KYDHTELDASVLPAPIIVR +dK_MMCCH-2 (K) | 3003 |
| 50 | 3022 | 3044 | 966.5219 | 2896.5439 | 2896.5521 | -2.83 | T | 1 | 16 | 0.027 | RPNNAVFDIIEIPIGKDVNLPPK +dK_MMCCH-2 (K) | 3037 |
| 51 | 123 | 151 | 616.6577 | 3693.9026 | 3693.9049 | -0.62 | T | 2 | 16 | 0.027 | KGFTDPPVKHHQSANLLVRKNINDLTREE +dK_MMCCH-2 (K) | 123 |
| 52 | 123 | 151 | 739.7898 | 3693.9126 | 3693.9049 | 2.06 | T | 2 | 20 | 0.01 | KGFTDPPVKHHQSANLLVRKNINDLTREE +dK_MMCCH-2 (K) | 131 |
| 53 | 158 | 176 | 846.3861 | 2536.1365 | 2536.1329 | 1.42 | G | 3 | 23 | 0.0055 | AFHKFQEDRSVDGYQATAE +dK_MMCCH-2 (K) | 161 |
| 54 | 526 | 544 | 777.7485 | 2330.2238 | 2330.2304 | -2.83 | G | 1 | 15 | 0.032 | VDGTKLASSLIPHASVIRE +dK_MMCCH-2 (K) | 530 |
| 55 | 589 | 612 | 990.1155 | 2967.3248 | 2967.3320 | -2.43 | G | 1 | 15 | 0.03 | DKSAGGFQQLGAFHGEPKWCPSPE +dK_MMCCH-2 (K) | 606 |
| 56 | 825 | 841 | 820.3744 | 2458.1013 | 2458.0940 | 2.97 | G | 1 | 22 | 0.0059 | HSVPFNVFDYKTNFNYE +dK_MMCCH-2 (K) | 835 |
| 57 | 942 | 972 | 955.4959 | 3817.9545 | 3817.9614 | -1.81 | G | 3 | 20 | 0.011 | VFDLKPASLGKDLFKQPSVIHEPRIGHHEGE +dK_MMCCH-2 (K) | 946 |
| 58 | 942 | 970 | 727.3887 | 3631.9073 | 3631.8973 | 2.73 | G | 2 | 19 | 0.014 | VFDLKPASLGKDLFKQPSVIHEPRIGHHE +dK_MMCCH-2 (K) | 956 |
| 59 | 1055 | 1076 | 967.1804 | 2898.5194 | 2898.5102 | 3.17 | G | 1 | 24 | 0.0039 | NALLKKGSSVAVPYWDWTKRIE +dK_MMCCH-2 (K) | 1060 |
| 60 | 1397 | 1413 | 774.4367 | 2320.2883 | 2320.2824 | 2.54 | G | 1 | 21 | 0.0074 | ITQLDKRQQLSLVKALE +dK_MMCCH-2 (K) | 1410 |
| 61 | 1506 | 1522 | 753.3771 | 2257.1094 | 2257.1089 | 0.22 | G | 1 | 20 | 0.009 | TGRDIPNPFIGSKIEFE +dK_MMCCH-2 (K) | 1518 |
| 62 | 1755 | 1765 | 570.6043 | 1708.7911 | 1708.7913 | -0.12 | G | 2 | 37 | 0.00022 | TLDKMNLRHDE +dK_MMCCH-2 (K) | 1758 |
| 63 | 2647 | 2661 | 715.6772 | 2144.0097 | 2144.0095 | 0.09 | G | 4 | 29 | 0.0012 | AEELRDALYKLQMDE +dK_MMCCH-2 (K) | 2656 |
| 64 | 59 | 68 | 729.3455 | 1456.6764 | 1456.6731 | 2.27 | C | 1 | 25 | 0.003 | VLGGPSEMKW +dK_MMCCH-2 (K); Oxidation (M) | 67 |

Figure 28 continued

| | | | | | | | | | |
|---|---|---|---|---|---|---|---|---|---|
| 65 | 94 | 100 | 573.2996 | 1144.5846 | 1144.5838 | 0.61 | C | 1 | 23 | 0.0048 | TVKAELF +dK_MMCCH-2 (K) | 96 |
| 66 | 160 | 171 | 606.9457 | 1817.8152 | 1817.8043 | 6.00 | C | 1 | 15 | 0.035 | HKFQEDRSVDGY +dK_MMCCH-2 (K) | 161 |
| 67 | 429 | 450 | 990.8041 | 2969.3906 | 2969.3899 | 0.24 | C | 1 | 41 | 7.40E-05 | GGISLENIEKMIHENQQEDRIY +dK_MMCCH-2 (K); Oxidation (M) | 438 |
| 68 | 584 | 595 | 787.4019 | 1572.7892 | 1572.7858 | 2.16 | C | 2 | 37 | 0.0002 | ALLKEDKSAGGF +dK_MMCCH-2 (K) | 590 |
| 69 | 715 | 723 | 655.8740 | 1309.7334 | 1309.7316 | 1.37 | C | 1 | 20 | 0.0092 | TSIAKQVLL +dK_MMCCH-2 (K) | 719 |
| 70 | 783 | 788 | 544.7759 | 1087.5373 | 1087.5372 | 0.09 | C | 1 | 30 | 0.0011 | QALQKY +dK_MMCCH-2 (K) | 787 |
| 71 | 830 | 838 | 743.3391 | 1484.6635 | 1484.6646 | -0.74 | C | 2 | 27 | 0.002 | NVFDYKTNF +dK_MMCCH-2 (K) | 835 |
| 72 | 918 | 928 | 856.9315 | 1711.8484 | 1711.8491 | -0.41 | C | 2 | 42 | 7.10E-05 | KYDITEKLHDL +dK_MMCCH-2 (K) | 924 |
| 73 | 944 | 955 | 821.4331 | 1640.8517 | 1640.8484 | 2.01 | C | 3 | 24 | 0.0036 | DLKPASLGKDLF +dK_MMCCH-2 (K) | 946 |
| 74 | 1013 | 1018 | 516.7581 | 1031.5017 | 1031.4998 | 1.84 | C | 0 | 14 | 0.038 | ESIAKF +dK_MMCCH-2 (K) | 1017 |
| 75 | 1330 | 1337 | 620.3556 | 1238.6966 | 1238.6944 | 1.78 | C | 1 | 21 | 0.0073 | KLDITKAL +dK_MMCCH-2 (K) | 1335 |
| 76 | 1649 | 1664 | 1127.9868 | 2253.9591 | 2253.9637 | -2.04 | C | 2 | 24 | 0.0037 | NLNDHTHDFSKPEDTF +dK_MMCCH-2 (K) | 1659 |
| 77 | 1649 | 1669 | 979.4308 | 2935.2705 | 2935.2759 | -1.84 | C | 4 | 15 | 0.029 | NLNDHTHDFSKPEDTFDYQKF +dK_MMCCH-2 (K) | 1668 |
| 78 | 1732 | 1742 | 792.8743 | 1583.7340 | 1583.7364 | -1.52 | C | 1 | 14 | 0.039 | TVLGGEKEMPW +dK_MMCCH-2 (K) | 1738 |
| 79 | 1818 | 1827 | 753.3699 | 1504.7253 | 1504.7232 | 1.40 | C | 1 | 22 | 0.0067 | SERDIGSLKY +dK_MMCCH-2 (K) | 1826 |
| 80 | 1913 | 1921 | 778.8339 | 1555.6532 | 1555.6541 | -0.58 | C | 2 | 13 | 0.048 | TDKEYYDVW +dK_MMCCH-2 (K) | 1915 |
| 81 | 2476 | 2488 | 923.9222 | 1845.8299 | 1845.8244 | 3.03 | C | 1 | 25 | 0.0032 | THSNAKPTDVFEY +dK_MMCCH-2 (K) | 2481 |
| 82 | 2656 | 2666 | 793.3528 | 1584.6910 | 1584.6879 | 2.02 | C | 1 | 23 | 0.0052 | KLQNDESHGGY +dK_MMCCH-2 (K) | 2656 |
| 83 | 2713 | 2723 | 787.9119 | 1573.8093 | 1573.8075 | 1.14 | C | 1 | 17 | 0.021 | KKHGSHLGIPY +dK_MMCCH-2 (K) | 2714 |
| 84 | 2809 | 2815 | 538.2600 | 1074.5055 | 1074.5056 | -0.09 | C | 0 | 31 | 0.00079 | IGGAEKY +dK_MMCCH-2 (K) | 2814 |
| 85 | 2946 | 2960 | 965.4038 | 1928.7931 | 1928.7986 | -2.85 | C | 1 | 27 | 0.0021 | IKSGTDSDDEYAGSF +dK_MMCCH-2 (K) | 2947 |
| 86 | 2961 | 2971 | 769.8921 | 1537.7696 | 1537.7673 | 1.50 | C | 1 | 13 | 0.048 | VILGGAKEMPW +dK_MMCCH-2 (K) | 2967 |
| 87 | 1 | 9 | 733.3350 | 1464.6554 | 1464.6516 | 2.53 | Th | 2 | 25 | 0.003 | MTPEELKTY +dK_MMCCH-2 (K); Oxidation (M) | 7 |

Figure 28 continued

| | | | | | | | | | |
|---|---|---|---|---|---|---|---|---|---|
| 88 | 38 | 56 | 861.6832 | 2582.0279 | 2582.0108 | 6.58 | Th | 2 | 25 | 0.0029 | VCIPDDNDRNDDHCEKAGD +dK_MMCCH-2 (K) | 53 |
| 89 | 59 | 69 | 785.3786 | 1568.7426 | 1568.7367 | 3.76 | Th | 3 | 54 | 4.20E-06 | VLGGPSEMKWQ +dK_MMCCH-2 (K) | 67 |
| 90 | 78 | 84 | 569.2875 | 1136.5604 | 1136.5536 | 5.98 | Th | 1 | 45 | 3.20E-05 | LSDTVHK +dK_MMCCH-2 (K) | 84 |
| 91 | 118 | 124 | 571.2790 | 1140.5435 | 1140.5386 | 4.30 | Th | 0 | 24 | 0.0042 | VHHPEKG +dK_MMCCH-2 (K) | 123 |
| 92 | 125 | 135 | 815.8901 | 1629.7656 | 1629.7610 | 2.82 | Th | 1 | 17 | 0.02 | FTDPPVKHHQS +dK_MMCCH-2 (K) | 131 |
| 93 | 272 | 282 | 848.3909 | 1694.7673 | 1694.7722 | -2.89 | Th | 1 | 22 | 0.0065 | FEENAPHTKRQ +Deamidated (NQ); dK_MMCCH-2 (K) | 280 |
| 94 | 431 | 439 | 707.8525 | 1413.6904 | 1413.6883 | 1.49 | Th | 3 | 40 | 0.00011 | ISLENIEKM +dK_MMCCH-2 (K) | 438 |
| 95 | 521 | 530 | 707.8452 | 1413.6759 | 1413.6698 | 4.32 | Th | 2 | 69 | 1.20E-07 | VDITEVDGTK +dK_MMCCH-2 (K) | 530 |
| 96 | 585 | 591 | 585.8106 | 1169.6065 | 1169.6002 | 5.47 | Th | 1 | 35 | 0.00032 | LLKEDKS +dK_MMCCH-2 (K) | 590 |
| 97 | 601 | 612 | 904.8967 | 1807.7789 | 1807.7698 | 5.03 | Th | 1 | 22 | 0.0064 | FHGEPKWCPSPE +dK_MMCCH-2 (K) | 606 |
| 98 | 666 | 672 | 607.2830 | 1212.5514 | 1212.5485 | 2.39 | Th | 2 | 23 | 0.0047 | LADHEKY +dK_MMCCH-2 (K) | 671 |
| 99 | 821 | 828 | 617.8124 | 1233.6102 | 1233.6064 | 3.08 | Th | 1 | 22 | 0.0063 | VTKEHSVP +dK_MMCCH-2 (K) | 823 |
| 100 | 832 | 837 | 563.2518 | 1124.4891 | 1124.4848 | 3.82 | Th | 1 | 29 | 0.0014 | FDYKTN +dK_MMCCH-2 (K) | 835 |
| 101 | 954 | 959 | 529.7658 | 1057.5169 | 1057.5154 | 1.42 | Th | 1 | 14 | 0.042 | LFKQPS +Deamidated (NQ); dK_MMCCH-2 (K) | 956 |
| 102 | 1111 | 1120 | 742.3787 | 1482.7429 | 1482.7388 | 2.77 | Th | 1 | 18 | 0.017 | ITTRDPKDSL +dK_MMCCH-2 (K) | 1117 |
| 103 | 1156 | 1164 | 630.8383 | 1259.6621 | 1259.6584 | 2.94 | Th | 2 | 19 | 0.013 | LLGGKGKYS +dK_MMCCH-2 (K) | 1162 |
| 104 | 1219 | 1232 | 653.9537 | 1958.8392 | 1958.8316 | 3.88 | Th | 1 | 25 | 0.0032 | FDKSDNNDEATKTH +dK_MMCCH-2 (K) | 1230 |
| 105 | 1579 | 1587 | 665.8126 | 1329.6106 | 1329.6064 | 3.16 | Th | 2 | 20 | 0.011 | WVGGKEPYG +dK_MMCCH-2 (K) | 1583 |
| 106 | 1657 | 1668 | 921.9197 | 1841.8249 | 1841.8182 | 3.64 | Th | 2 | 32 | 0.00058 | FSKPEDTFDYQK +dK_MMCCH-2 (K) | 1659 |
| 107 | 1657 | 1668 | 921.9213 | 1841.8280 | 1841.8182 | 5.32 | Th | 2 | 44 | 4.20E-05 | FSKPEDTFDYQK +dK_MMCCH-2 (K) | 1668 |
| 108 | 1733 | 1741 | 664.3256 | 1326.6367 | 1326.6312 | 4.15 | Th | 2 | 14 | 0.04 | VLGGEKEMP +dK_MMCCH-1 (K); Oxidation (M) | 1738 |
| 109 | 1894 | 1904 | 850.4187 | 1698.8228 | 1698.8116 | 6.59 | Th | 5 | 34 | 0.00044 | VAVPVWDWTKP +dK_MMCCH-2 (K) | 1903 |
| 110 | 2064 | 2068 | 499.7599 | 997.5052 | 997.5055 | -0.40 | Th | 0 | 19 | 0.014 | FTKKH +dK_MMCCH-2 (K) | 2067 |

Figure 28 continued

| 111 | 2094 | 2100 | 618.3057 | 1234.5968 | 1234.5903 | 5.18 | Th | 1 | 26 | 0.0023 | LHEIEKE +dK_MMCCH-2 (K) | 2099 |
|---|---|---|---|---|---|---|---|---|---|---|---|---|
| 112 | 2129 | 2141 | 622.9242 | 1865.7507 | 1865.7495 | 0.64 | Th | 0 | 26 | 0.0026 | ICKTSEDCHHGGQ +dK_MMCCH-2 (K) | 2131 |
| 113 | 2238 | 2249 | 814.4017 | 1626.7888 | 1626.7811 | 4.73 | Th | 4 | 38 | 0.00015 | LTTAEVDNLKDA +dK_MMCCH-2 (K) | 2247 |
| 114 | 2480 | 2487 | 622.7999 | 1243.5852 | 1243.5795 | 4.58 | Th | 2 | 17 | 0.019 | AKPTDVFE +dK_MMCCH-2 (K) | 2481 |
| 115 | 2512 | 2521 | 538.6006 | 1612.7799 | 1612.7766 | 2.05 | Th | 0 | 41 | 8.60E-05 | LEKQKEEDRT +dK_MMCCH-2 (K) | 2514 |
| 116 | 2595 | 2606 | 806.4045 | 1610.7945 | 1610.7862 | 5.15 | Th | 2 | 26 | 0.0026 | IIDTSGKQLPSD +dK_MMCCH-2 (K) | 2601 |
| 117 | 2607 | 2612 | 520.7819 | 1039.5493 | 1039.5446 | 4.52 | Th | 2 | 25 | 0.0035 | LIKMPT +dK_MMCCH-2 (K) | 2609 |
| 118 | 2766 | 2771 | 551.7871 | 1101.5597 | 1101.5529 | 6.17 | Th | 1 | 25 | 0.0029 | IFQQTK +dK_MMCCH-2 (K) | 2771 |
| 119 | 2809 | 2816 | 581.7781 | 1161.5416 | 1161.5376 | 3.44 | Th | 2 | 13 | 0.045 | IGGAEKYS +dK_MMCCH-2 (K) | 2814 |
| 120 | 2946 | 2960 | 965.4075 | 1928.8004 | 1928.7986 | 0.93 | Th | 3 | 68 | 1.40E-07 | IKSGTDSDDEYAGSF +dK_MMCCH-2 (K) | 2947 |
| 121 | 2990 | 2996 | 583.2851 | 1164.5556 | 1164.5485 | 6.10 | Th | 1 | 33 | 0.00047 | LTDDHVK +dK_MMCCH-2 (K) | 2996 |

Figure 28 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1043.0237 | 2084.0328 | 2084.0347 | -0.91 | T | 1 | 54 | 4.20E-06 | KNVDSLSSDEVLALEK +dK_MMCCH-2 (K) | 26 |
| 2 | 147 | 155 | 694.3700 | 1386.7254 | 1386.7217 | 2.67 | T | 1 | 22 | 0.007 | ADITFLNKK +dK_MMCCH-2 (K) | 155 |
| 3 | 161 | 175 | 596.3071 | 1785.8996 | 1785.8985 | 0.62 | T | 1 | 36 | 0.00024 | LFEKVQPGHHTR +dK_MMCCH-2 (K) | 167 |
| 4 | 249 | 271 | 987.4432 | 2959.3077 | 2959.3051 | 0.88 | T | 1 | 28 | 0.0018 | GKDPNSADCAHNLIHTPMEPFDR +dK_MMCCH-2 (K) | 250 |
| 5 | 281 | 293 | 610.9432 | 1829.8079 | 1829.8043 | 1.97 | T | 0 | 55 | 3.30E-06 | EHAKPADSFDYGR +dK_MMCCH-2 (K) | 284 |
| 6 | 359 | 377 | 849.3962 | 2545.1669 | 2545.1810 | -5.58 | T | 1 | 14 | 0.041 | AGDFFLLGGPTEMKWGFYR +dK_MMCCH-2 (K) | 372 |
| 7 | 419 | 446 | 677.3699 | 3381.8130 | 3381.8132 | -0.06 | T | 1 | 45 | 3.20E-05 | QPTLVHRPAKGHFDKPPVVAQANLAVR +Deamidated (NQ); dK_MMCCH-2 (K) | 428 |
| 8 | 429 | 446 | 752.0659 | 2253.1759 | 2253.1729 | 1.38 | T | 0 | 50 | 1.10E-05 | GHFDKPPVVAQANLAVR +dK_MMCCH-2 (K) | 433 |
| 9 | 467 | 488 | 944.4543 | 2830.3410 | 2830.3385 | 0.88 | T | 1 | 70 | 9.50E-08 | FQNDKSVDGYQATVEHALPAR +dK_MMCCH-2 (K) | 471 |
| 10 | 908 | 924 | 620.2817 | 2477.0979 | 2477.1166 | -7.59 | T | 1 | 18 | 0.017 | KFACCVHGMAVFPHWHR +dK_MMCCH-2 (K) | 908 |
| 11 | 936 | 950 | 1080.0133 | 2158.0121 | 2158.0095 | 1.20 | T | 1 | 40 | 0.0001 | KHGFTGGLPYWDWTR +dK_MMCCH-2 (K) | 936 |
| 12 | 1082 | 1096 | 996.4623 | 1990.9100 | 1990.9063 | 1.86 | T | 0 | 14 | 0.041 | GKPYNTANCAIASMR +dK_MMCCH-2 (K) | 1083 |
| 13 | 1097 | 1115 | 827.0796 | 2478.2169 | 2478.2101 | 2.78 | T | 0 | 81 | 8.40E-09 | KPLQPFGLDSVINPDDETR +dK_MMCCH-2 (K) | 1097 |
| 14 | 1123 | 1149 | 1190.5598 | 3568.6576 | 3568.6497 | 2.21 | T | 1 | 67 | 1.80E-07 | VFDYKNNFDYEYESLAFNGLSIAQLDR +dK_MMCCH-2 (K) | 1127 |
| 15 | 1295 | 1311 | 764.0689 | 2289.1849 | 2289.1715 | 5.85 | T | 1 | 17 | 0.022 | SAFLQIQKEGIYENIAK +dK_MMCCH-2 (K) | 1302 |
| 16 | 1355 | 1385 | 953.7057 | 3810.7937 | 3810.7876 | 1.60 | T | 1 | 61 | 8.90E-07 | GSAVAVPYWDWTEKADSLPSLINDATYFNSR +dK_MMCCH-2 (K) | 1368 |
| 17 | 1409 | 1450 | 1371.8844 | 5483.5085 | 5483.5213 | -2.33 | T | 1 | 33 | 0.00047 | DPQPELWDNKDFYENVMLALEQDNFCDFEIQLELIHNALHSR +dK_MMCCH-2 (K) | 1418 |
| 18 | 1455 | 1480 | 1117.8724 | 3350.5955 | 3350.6070 | -3.43 | T | 1 | 58 | 1.50E-06 | AKYSLSSLDYTAFDPVFFLHHANVDR +dK_MMCCH-2 (K) | 1456 |

Figure 28 continued

| | | | | | | | | | | |
|---|---|---|---|---|---|---|---|---|---|---|
| 19 | 1493 | 1507 | 721.6637 | 2161.9693 | 2161.9594 | 4.53 | T | 1 | 58 | 1.50E-06 | KKPVNEADCAVNEMR +dK_MMCCH-2 (K) | 1494 |
| 20 | 1508 | 1539 | 825.9995 | 4124.9609 | 4124.9360 | 6.04 | T | 1 | 25 | 0.0033 | KPLQPFNNPELNSDSMTLKHNLPQDSFDYQNR +dK_MMCCH-2 (K) | 1526 |
| 21 | 1542 | 1564 | 1070.1924 | 3207.5553 | 3207.5448 | 3.30 | T | 1 | 18 | 0.018 | YQYDNLQFNHFSIQKLDQTIQAR +dK_MMCCH-2 (K) | 1556 |
| 22 | 1625 | 1646 | 906.8055 | 2717.3946 | 2717.3887 | 2.17 | T | 1 | 22 | 0.0062 | FDITSALHKLGVPLDGHGFDIK +dK_MMCCH-2 (K) | 1633 |
| 23 | 1757 | 1768 | 612.9796 | 1835.9168 | 1835.9128 | 2.23 | T | 1 | 18 | 0.015 | LYTVQFEDSLKR +dK_MMCCH-2 (K) | 1767 |
| 24 | 1949 | 1963 | 560.2521 | 2236.9792 | 2236.9735 | 2.55 | T | 0 | 52 | 6.90E-06 | TQEFSKPEDTFDYHR +dK_MMCCH-2 (K) | 1954 |
| 25 | 2045 | 2052 | 660.3497 | 1318.6848 | 1318.6843 | 0.38 | T | 1 | 21 | 0.0073 | YDITKTLK +dK_MMCCH-2 (K) | 2049 |
| 26 | 2058 | 2069 | 909.4633 | 1816.9121 | 1816.9070 | 2.81 | T | 1 | 14 | 0.036 | YDDTFTIKVHIK +dK_MMCCH-2 (K) | 2065 |
| 27 | 2228 | 2239 | 870.4176 | 1738.8206 | 1738.8236 | -1.73 | T | 1 | 14 | 0.036 | GYIKSEDAYTVR +dK_MMCCH-2 (K) | 2231 |
| 28 | 2527 | 2541 | 1007.5128 | 2013.0110 | 2013.0088 | 1.04 | T | 1 | 56 | 2.30E-06 | KDVTSLTASEIENLR +dK_MMCCH-2 (K) | 2527 |
| 29 | 2755 | 2764 | 764.3820 | 1526.7494 | 1526.7439 | 3.60 | T | 0 | 19 | 0.012 | QPLKPFSESR +Deamidated (NQ); dK_MMCCH-2 (K) | 2758 |
| 30 | 2866 | 2873 | 659.3597 | 1316.7048 | 1316.7050 | -0.15 | T | 1 | 13 | 0.046 | YDITKVLK +dK_MMCCH-2 (K) | 2870 |
| 31 | 3148 | 3155 | 629.3353 | 1256.6561 | 1256.6587 | -2.07 | T | 1 | 17 | 0.02 | KKPVNAAK +dK_MMCCH-2 (K) | 3149 |
| 32 | 466 | 481 | 1098.4951 | 2194.9757 | 2194.9841 | -3.83 | G | 2 | 25 | 0.0035 | RFQNDKSVDGYQATVE +Deamidated (NQ); dK_MMCCH-2 (K) | 471 |
| 33 | 1215 | 1235 | 962.1380 | 2883.3922 | 2883.3789 | 4.58 | G | 3 | 15 | 0.033 | ITQQLHDLDLHVGDNFFLKYE +Deamidated (NQ); dK_MMCCH-2 (K) | 1233 |
| 34 | 2477 | 2484 | 644.8370 | 1287.6594 | 1287.6573 | 1.63 | G | 0 | 15 | 0.031 | APFFIKVE +dK_MMCCH-2 (K) | 2482 |
| 35 | 1292 | 1303 | 586.6456 | 1756.9151 | 1756.9182 | -1.76 | G | 0 | 21 | 0.008 | SIRSAFLQIQKE +dK_MMCCH-2 (K) | 1302 |
| 36 | 1292 | 1303 | 879.4651 | 1756.9156 | 1756.9182 | -1.42 | G | 0 | 39 | 0.00011 | SIRSAFLQIQKE +dK_MMCCH-2 (K) | 1302 |
| 37 | 1292 | 1303 | 879.4658 | 1756.9170 | 1756.9182 | -0.68 | G | 0 | 39 | 0.00012 | SIRSAFLQIQKE +dK_MMCCH-2 (K) | 1302 |
| 38 | 1292 | 1303 | 879.4702 | 1756.9259 | 1756.9182 | 4.38 | G | 0 | 26 | 0.0026 | SIRSAFLQIQKE +dK_MMCCH-2 (K) | 1302 |
| 39 | 1308 | 1320 | 603.6327 | 1807.8762 | 1807.8749 | 0.72 | G | 0 | 16 | 0.023 | NIAKFHGKPGLCE +dK_MMCCH-2 (K) | 1315 |
| 40 | 1290 | 1303 | 667.3554 | 1999.0444 | 1999.0448 | -0.20 | G | 1 | 17 | 0.02 | IESIRSAFLQIQKE +dK_MMCCH-2 (K) | 1302 |
| 41 | 1290 | 1303 | 1000.5361 | 1999.0576 | 1999.0448 | 6.40 | G | 1 | 45 | 3.00E-05 | IESIRSAFLQIQKE +dK_MMCCH-2 (K) | 1302 |

Figure 28 continued

| | | | | | | | | | | |
|---|---|---|---|---|---|---|---|---|---|---|
| 42 | 466 | 481 | 732.3397 | 2193.9973 | 2194.0001 | -1.28 | G | 2 | 15 | 0.032 | RFQNDKSVDGYQATVE +dK_MMCCH-2 (K) | 471 |
| 43 | 466 | 481 | 1098.0066 | 2193.9986 | 2194.0001 | -0.68 | G | 2 | 16 | 0.026 | RFQNDKSVDGYQATVE +dK_MMCCH-2 (K) | 471 |
| 44 | 466 | 481 | 732.3409 | 2194.0008 | 2194.0001 | 0.32 | G | 2 | 16 | 0.026 | RFQNDKSVDGYQATVE +dK_MMCCH-2 (K) | 471 |
| 45 | 1952 | 1967 | 594.7626 | 2375.0212 | 2375.0205 | 0.29 | G | 3 | 18 | 0.017 | FSKPEDTFDYHRFGYE +dK_MMCCH-2 (K) | 1954 |
| 46 | 1952 | 1967 | 792.6822 | 2375.0247 | 2375.0205 | 1.77 | G | 3 | 21 | 0.0089 | FSKPEDTFDYHRFGYE +dK_MMCCH-2 (K) | 1954 |
| 47 | 3386 | 3405 | 877.4151 | 2629.2235 | 2629.2271 | -1.37 | G | 2 | 15 | 0.031 | LDHAYSLRDGHYYIAGPTKD +dK_MMCCH-2 (K) | 3404 |
| 48 | 3386 | 3405 | 658.3136 | 2629.2253 | 2629.2271 | -0.68 | G | 2 | 13 | 0.045 | LDHAYSLRDGHYYIAGPTKD +dK_MMCCH-2 (K) | 3404 |
| 49 | 1403 | 1422 | 921.4198 | 2761.2376 | 2761.2330 | 1.67 | G | 3 | 14 | 0.038 | NAVTSRDPQPELWDNKDFYE +dK_MMCCH-2 (K) | 1418 |
| 50 | 1215 | 1235 | 961.8065 | 2882.3976 | 2882.3949 | 0.90 | G | 3 | 32 | 0.00065 | ITQQLHDLDHVGDNFFLKYE +dK_MMCCH-2 (K) | 1233 |
| 51 | 1215 | 1235 | 721.6078 | 2882.4021 | 2882.3949 | 2.46 | G | 3 | 18 | 0.018 | ITQQLHDLDHVGDNFFLKYE +dK_MMCCH-2 (K) | 1233 |
| 52 | 1973 | 1990 | 817.0586 | 2448.1541 | 2448.1454 | 3.59 | G | 0 | 16 | 0.028 | FVGMSVSSLHNYIKQQQE +dK_MMCCH-2 (K); Oxidation (M) | 1986 |
| 53 | 277 | 296 | 883.7546 | 2648.2419 | 2648.2329 | 3.40 | C | 4 | 38 | 0.00017 | DLTREHAKPADSFDYGRLGY +dK_MMCCH-2 (K) | 284 |
| 54 | 315 | 325 | 808.4200 | 1614.8254 | 1614.8188 | 4.09 | C | 1 | 13 | 0.049 | LGERAAKERTF +dK_MMCCH-2 (K) | 321 |
| 55 | 629 | 635 | 539.2531 | 1076.4917 | 1076.4848 | 6.32 | C | 0 | 19 | 0.014 | VGGSEKY +dK_MMCCH-2 (K) | 634 |
| 56 | 1075 | 1080 | 544.7759 | 1087.5373 | 1087.5372 | 0.09 | C | 1 | 30 | 0.0011 | QALQKY +dK_MMCCH-2 (K) | 1079 |
| 57 | 1125 | 1134 | 854.8457 | 1707.6768 | 1707.6763 | 0.35 | C | 3 | 20 | 0.011 | DYKNNFDYEY +dK_MMCCH-2 (K) | 1127 |
| 58 | 1165 | 1177 | 896.9915 | 1791.9685 | 1791.9593 | 5.13 | C | 3 | 15 | 0.031 | LLHEIGQSALVKF +dK_MMCCH-2 (K) | 1176 |
| 59 | 1526 | 1540 | 749.6849 | 2246.0330 | 2246.0215 | 5.12 | C | 2 | 38 | 0.00015 | KHNLPQDSFDYQNRF +dK_MMCCH-2 (K) | 1526 |
| 60 | 1696 | 1702 | 607.3009 | 1212.5872 | 1212.5849 | 1.90 | C | 1 | 17 | 0.022 | TTLEKHF +dK_MMCCH-2 (K) | 1700 |
| 61 | 1708 | 1719 | 839.8434 | 1677.6723 | 1677.6651 | 4.35 | C | 0 | 28 | 0.0015 | KNMQADDSPDGY +dK_MMCCH-2 (K) | 1708 |
| 62 | 1801 | 1809 | 706.8389 | 1411.6632 | 1411.6595 | 2.62 | C | 0 | 16 | 0.026 | SHKTFPNPF +dK_MMCCH-2 (K) | 1803 |
| 63 | 1985 | 1995 | 850.4283 | 1698.8421 | 1698.8399 | 1.30 | C | 0 | 39 | 0.00014 | IKQQQEADRVF +dK_MMCCH-2 (K) | 1986 |
| 64 | 2001 | 2011 | 726.8464 | 1451.6783 | 1451.6755 | 1.93 | C | 1 | 28 | 0.0014 | KGFGQSASVSF +dK_MMCCH-2 (K) | 2001 |

Figure 28 continued

| 65 | 2463 | 2479 | 1128.0177 | 2254.0208 | 2254.0253 | -1.95 | C | 1 | 23 | 0.0055 | KAQSIHPEDVFDTDAPF +dK_MMCCH-2 (K) | 2463 |
|---|---|---|---|---|---|---|---|---|---|---|---|---|
| 66 | 2754 | 2760 | 598.3302 | 1194.6458 | 1194.6471 | -1.00 | C | 1 | 25 | 0.0033 | KQPLKPF +dK_MMCCH-2 (K) | 2754 |
| 67 | 2754 | 2760 | 598.3341 | 1194.6537 | 1194.6471 | 5.52 | C | 1 | 14 | 0.041 | KQPLKPF +dK_MMCCH-2 (K) | 2758 |
| 68 | 2865 | 2872 | 673.3649 | 1344.7152 | 1344.7112 | 2.97 | C | 1 | 19 | 0.012 | RYDITKVL +dK_MMCCH-2 (K) | 2870 |
| 69 | 3235 | 3242 | 617.3129 | 1232.6112 | 1232.6111 | 0.08 | C | 0 | 34 | 0.00039 | TSANVKIY +dK_MMCCH-2 (K) | 3240 |
| 70 | 3399 | 3406 | 576.8040 | 1151.5934 | 1151.5896 | 3.21 | C | 0 | 23 | 0.005 | IAGPTKDL +dK_MMCCH-2 (K) | 3404 |
| 71 | 184 | 191 | 703.8063 | 1405.5980 | 1405.5894 | 6.12 | Th | 1 | 29 | 0.0013 | LEQDEFCK +dK_MMCCH-2 (K) | 191 |
| 72 | 247 | 257 | 785.8562 | 1569.6978 | 1569.6916 | 4.01 | Th | 1 | 20 | 0.0099 | LRGKDPNSADC +dK_MMCCH-2 (K) | 250 |
| 73 | 283 | 293 | 782.8611 | 1563.7077 | 1563.7028 | 3.20 | Th | 3 | 34 | 0.00038 | AKPADSFDYGR +dK_MMCCH-2 (K) | 284 |
| 74 | 365 | 372 | 585.7803 | 1169.5461 | 1169.5461 | 0.00 | Th | 1 | 31 | 0.00085 | LGGPTEMK +dK_MMCCH-2 (K) | 372 |
| 75 | 431 | 437 | 569.2877 | 1136.5609 | 1136.5576 | 2.90 | Th | 1 | 15 | 0.034 | FDKPPVP +dK_MMCCH-2 (K) | 433 |
| 76 | 629 | 636 | 582.7676 | 1163.5206 | 1163.5169 | 3.18 | Th | 1 | 22 | 0.0064 | VGGSEKYS +dK_MMCCH-2 (K) | 634 |
| 77 | 893 | 904 | 904.8967 | 1807.7789 | 1807.7698 | 5.03 | Th | 1 | 22 | 0.0064 | FHGEPKWCPSPE +dK_MMCCH-2 (K) | 898 |
| 78 | 1124 | 1129 | 569.7510 | 1137.4875 | 1137.4801 | 6.51 | Th | 1 | 13 | 0.049 | FDYKNN +dK_MMCCH-2 (K) | 1127 |
| 79 | 1525 | 1539 | 738.3566 | 2212.0481 | 2212.0371 | 4.93 | Th | 3 | 49 | 1.30E-05 | LKHNLPQDSFDYQNR +dK_MMCCH-2 (K) | 1526 |
| 80 | 1589 | 1605 | 735.3315 | 2202.9728 | 2202.9708 | 0.91 | Th | 2 | 18 | 0.015 | ICVEQGGEQNCKTKAGS +dK_MMCCH-2 (K) | 1600 |
| 81 | 1589 | 1605 | 735.3331 | 2202.9776 | 2202.9708 | 3.09 | Th | 2 | 34 | 0.00042 | ICVEQGGEQNCKTKAGS +dK_MMCCH-2 (K) | 1602 |
| 82 | 1800 | 1809 | 780.3743 | 1558.7340 | 1558.7279 | 3.91 | Th | 2 | 24 | 0.004 | FSHKTFPNPF +dK_MMCCH-2 (K) | 1803 |
| 83 | 1952 | 1963 | 627.2844 | 1878.8314 | 1878.8247 | 3.57 | Th | 2 | 47 | 2.00E-05 | FSKPEDTFDYHR +dK_MMCCH-2 (K) | 1954 |
| 84 | 1985 | 1994 | 776.8963 | 1551.7780 | 1551.7715 | 4.19 | Th | 2 | 20 | 0.0095 | IKQQQEADRV +dK_MMCCH-2 (K) | 1986 |
| 85 | 2193 | 2199 | 667.3038 | 1332.5931 | 1332.5849 | 6.15 | Th | 2 | 30 | 0.0011 | YWDWTKP +dK_MMCCH-2 (K) | 2198 |
| 86 | 2200 | 2206 | 562.3095 | 1122.6045 | 1122.5995 | 4.45 | Th | 2 | 21 | 0.0077 | ISKLPDL +dK_MMCCH-2 (K) | 2202 |
| 87 | 2225 | 2229 | 462.2224 | 922.4301 | 922.4259 | 4.66 | Th | 2 | 24 | 0.0039 | FAKGY +dK_MMCCH-2 (K) | 2227 |

Figure 28 continued

| 88 | 2941 | 2950 | 720.8415 | 1439.6684 | 1439.6602 | 5.70 | Th | 3 | 46 | 2.60E-05 | LDEANDLKNA+dK_MMCCH-2 (K) | 2948 |
|---|---|---|---|---|---|---|---|---|---|---|---|---|
| 89 | 3009 | 3015 | 573.2734 | 1144.5322 | 1144.5335 | -1.14 | Th | 0 | 16 | 0.025 | LKEHGSH+dK_MMCCH-2 (K) | 3010 |
| 90 | 3020 | 3026 | 662.2908 | 1322.5671 | 1322.5642 | 2.19 | Th | 2 | 19 | 0.011 | YWDWTKS+dK_MMCCH-2 (K) | 3025 |
| 91 | 3399 | 3405 | 520.2607 | 1038.5069 | 1038.5056 | 1.25 | Th | 1 | 27 | 0.002 | IAGPTKD+dK_MMCCH-2 (K) | 3404 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the lysine conjugation site for KLH1 or KLH2.

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 124 | 141 | 785.4094 | 2353.2064 | 2353.2001 | 2.68 | T | 1 | 15 | 0.034 | GFTDPPVKHHQSANILVR +dK_MMCCH-2 (K) | 131 |
| 2 | 142 | 149 | 656.3414 | 1310.6682 | 1310.6653 | 2.21 | T | 1 | 29 | 0.0012 | KNINDLTR +dK_MMCCH-2 (K) | 142 |
| 3 | 157 | 166 | 548.9227 | 1643.7464 | 1643.7402 | 3.71 | T | 1 | 21 | 0.008 | EAFHKFQEDR +dK_MMCCH-2 (K) | 161 |
| 4 | 184 | 192 | 484.8979 | 1451.6719 | 1451.6649 | 4.82 | T | 1 | 14 | 0.039 | CPRPDAKDR +dK_MMCCH-2 (K) | 190 |
| 5 | 553 | 560 | 663.8693 | 1325.7240 | 1325.7166 | 5.58 | T | 2 | 22 | 0.0068 | VKFDKVPR +dK_MMCCH-2 (K) | 554 |
| 6 | 566 | 570 | 485.2459 | 968.4772 | 968.4749 | 2.37 | T | 1 | 19 | 0.014 | KNVDR +dK_MMCCH-2 (K) | 566 |
| 7 | 581 | 590 | 733.9196 | 1465.8246 | 1465.8214 | 2.18 | T | 2 | 30 | 0.0011 | KALALLKEDK +dK_MMCCH-2 (K) | 581 |
| 8 | 588 | 606 | 781.0378 | 2340.0917 | 2340.0845 | 3.08 | T | 1 | 15 | 0.031 | EDKSAGGFQQLGAFHGEPK +dK_MMCCH-2 (K) | 590 |
| 9 | 591 | 615 | 1004.4722 | 3010.3949 | 3010.3742 | 6.88 | T | 1 | 16 | 0.027 | SAGGFQQLGAFHGEPKWCPSPEASK +dK_MMCCH-2 (K) | 606 |
| 10 | 682 | 699 | 620.2965 | 2477.1567 | 2477.1434 | 5.37 | T | 1 | 15 | 0.03 | HNPWFDGHIDTVDKTTTR +dK_MMCCH-2 (K) | 695 |
| 11 | 700 | 719 | 887.7751 | 2660.3034 | 2660.2945 | 3.38 | T | 1 | 20 | 0.0097 | SVQNKLFEQPEFGHYTSIAK +dK_MMCCH-2 (K) | 704 |
| 12 | 778 | 789 | 958.0043 | 1913.9941 | 1913.9862 | 4.13 | T | 1 | 15 | 0.03 | IWAIWQALQKYR +Deamidated (NQ); dK_MMCCH-2 (K) | 787 |
| 13 | 790 | 804 | 1003.4770 | 2004.9394 | 2004.9220 | 8.73 | T | 0 | 81 | 7.20E-09 | GKPYNVANCAVTSMR +dK_MMCCH-2 (K) | 791 |
| 14 | 858 | 863 | 520.3001 | 1038.5857 | 1038.5783 | 7.03 | T | 1 | 15 | 0.028 | KLEAIK +dK_MMCCH-2 (K) | 858 |
| 15 | 859 | 867 | 699.3604 | 1396.7061 | 1396.7020 | 2.94 | T | 1 | 15 | 0.034 | LEAIKSQDR +dK_MMCCH-2 (K) | 863 |
| 16 | 879 | 884 | 500.2828 | 998.5511 | 998.5470 | 4.11 | T | 1 | 14 | 0.04 | KSSLVK +dK_MMCCH-2 (K) | 879 |
| 17 | 953 | 965 | 635.3318 | 1902.9735 | 1902.9662 | 3.84 | T | 1 | 48 | 1.50E-05 | DLFKQPSVIHEPR +dK_MMCCH-2 (K) | 956 |
| 18 | 986 | 1000 | 685.0270 | 2052.0591 | 2052.0561 | 1.46 | T | 1 | 23 | 0.0047 | KNIENLSLGELESLR +dK_MMCCH-2 (K) | 986 |

| | | | | | | | | | |
|---|---|---|---|---|---|---|---|---|---|
| 19 | 1048 | 1060 | 913.5313 | 1825.0481 | 1825.0423 | 3.18 | T | 1 | 35 | 0.0003 | LYVVVENALLKK +dK_MMCCH-2 (K) | 1060 |
| 20 | 1092 | 1114 | 791.8763 | 3163.4760 | 3163.4682 | 2.47 | T | 1 | 42 | 6.40E-05 | QHHYETNPFHHGKITHENEITTR +dK_MMCCH-2 (K) | 1104 |
| 21 | 1199 | 1203 | 353.1925 | 1056.5556 | 1056.5538 | 1.61 | T | 1 | 17 | 0.018 | KRPYR +dK_MMCCH-2 (K) | 1199 |
| 22 | 1395 | 1403 | 485.5970 | 1453.7692 | 1453.7599 | 6.40 | T | 2 | 31 | 0.00082 | KDITQLDKR +dK_MMCCH-2 (K) | 1395 |
| 23 | 1473 | 1489 | 778.4048 | 2332.1925 | 2332.1827 | 4.20 | T | 1 | 38 | 0.00015 | KHGAVVGLPYWDWTLPR +dK_MMCCH-2 (K) | 1473 |
| 24 | 1510 | 1530 | 599.6281 | 1795.8623 | 1795.8663 | 3.34 | T | 1 | 20 | 0.0096 | IEFEGENVHTKR +dK_MMCCH-2 (K) | 1529 |
| 25 | 1747 | 1758 | 613.9781 | 1838.9124 | 1838.9012 | 6.14 | T | 1 | 18 | 0.014 | LYKYDITETLDK +dK_MMCCH-2 (K) | 1749 |
| 26 | 1923 | 1932 | 756.3818 | 1510.7491 | 1510.7425 | 4.43 | T | 1 | 22 | 0.0064 | NKVMPNPFAR +dK_MMCCH-2 (K) | 1924 |
| 27 | 2100 | 2109 | 492.2497 | 1964.9698 | 1964.9601 | 4.94 | T | 2 | 16 | 0.027 | EIKDKQHHVR +2 dK_MMCCH-2 (K) | 2102, 2104 |
| 28 | 2121 | 2149 | 890.4196 | 3557.6494 | 3557.6378 | 3.26 | T | 1 | 23 | 0.0049 | TSADVQFQICKTSEDCHHGGQIFVLGGTK +dK_MMCCH-2 (K) | 2131 |
| 29 | 2299 | 2314 | 715.0188 | 2142.0346 | 2142.0238 | 5.04 | T | 1 | 37 | 0.00019 | LYTKQMEDALTAHGAR +dK_MMCCH-2 (K) | 2302 |
| 30 | 2359 | 2367 | 736.3524 | 1470.6903 | 1470.6813 | 6.12 | T | 1 | 32 | 0.00064 | DKLFNDPER +dK_MMCCH-2 (K) | 2360 |
| 31 | 2461 | 2490 | 642.8185 | 3850.8672 | 3850.8638 | 0.88 | T | 0 | 18 | 0.015 | RPLRPFSDPINHNAFTHSNAKPTDVFEYSR +dK_MMCCH-2 (K) | 2481 |
| 32 | 2507 | 2514 | 682.3542 | 1362.6938 | 1362.6853 | 6.24 | T | 1 | 33 | 0.00051 | KLEHELEK +dK_MMCCH-2 (K) | 2507 |
| 33 | 2515 | 2520 | 571.7616 | 1141.5086 | 1141.5074 | 1.14 | T | 1 | 17 | 0.018 | QKEEDR +dK_MMCCH-2 (K) | 2516 |
| 34 | 2621 | 2636 | 802.7122 | 2405.1147 | 2405.1083 | 2.62 | T | 1 | 51 | 8.10E-06 | HHEKHHEDHHEDILVR +dK_MMCCH-2 (K) | 2624 |
| 35 | 2637 | 2651 | 713.3541 | 2137.0404 | 2137.0374 | 1.36 | T | 1 | 59 | 1.20E-06 | KNIHSLSHHEAEELR +dK_MMCCH-2 (K) | 2637 |
| 36 | 2851 | 2883 | 807.5740 | 4032.8335 | 4032.8346 | -0.27 | T | 0 | 42 | 6.80E-05 | VKPAHAGSCAGDIMHVPLHPFNYESVNNDDFTR +dK_MMCCH-2 (K) | 2852 |
| 37 | 2897 | 2919 | 800.1400 | 3196.5307 | 3196.5287 | 0.63 | T | 1 | 45 | 3.50E-05 | FNYKYDNLNLHGHNIEELEEVLR +dK_MMCCH-2 (K) | 2900 |
| 38 | 3003 | 3021 | 825.7752 | 2474.3036 | 2474.2879 | 6.35 | T | 1 | 17 | 0.018 | KYDHTELDASVLPAPIIVR +dK_MMCCH-2 (K) | 3003 |
| 39 | 123 | 151 | 673.0145 | 4032.0434 | 4032.0350 | 2.08 | G | 2 | 18 | 0.017 | KGFTDPPVKHHQSANLLVRKNINDLTREE +2 dK_MMCCH-2 (K) | 123, 131 |
| 40 | 123 | 151 | 739.7914 | 3693.9208 | 3693.9049 | 4.30 | G | 2 | 32 | 0.00068 | KGFTDPPVKHHQSANLLVRKNINDLTREE +dK_MMCCH-2 (K) | 131 |
| 41 | 158 | 169 | 606.2845 | 1815.8318 | 1815.8250 | 3.74 | G | 2 | 27 | 0.0019 | AFHKFQEDRSVD +dK_MMCCH-2 (K) | 161 |

Figure 29 continued

| | | | | | | | | | | | |
|---|---|---|---|---|---|---|---|---|---|---|---|
| 42 | 435 | 442 | 676.3252 | 1350.6358 | 1350.6312 | 3.48 | G | 1 | 21 | 0.008 | NIEKMIHE +dK_MMCCH-2 (K) | 438 |
| 43 | 526 | 544 | 777.7501 | 2330.2285 | 2330.2304 | -0.82 | G | 1 | 15 | 0.029 | VDGTKLASSLIPHASVIRE +dK_MMCCH-2 (K) | 530 |
| 44 | 589 | 612 | 990.1202 | 2967.3389 | 2967.3320 | 2.33 | G | 1 | 31 | 0.0008 | DKSAGGFQQLGAFHGEPKWCPSPE +dK_MMCCH-2 (K) | 606 |
| 45 | 825 | 841 | 820.3759 | 2458.1057 | 2458.0940 | 4.76 | G | 1 | 25 | 0.0031 | HSVPFNVFDYKTNFNYE +dK_MMCCH-2 (K) | 835 |
| 46 | 847 | 860 | 965.0205 | 1928.0265 | 1928.0077 | 9.75 | G | 0 | 19 | 0.013 | FNGLSISQLNKKLE +dK_MMCCH-2 (K) | 858 |
| 47 | 942 | 970 | 908.9841 | 3631.9074 | 3631.8873 | 2.78 | C | 2 | 15 | 0.035 | VFDLKPASLGKDLFKQPSVIHEPRIGHHE +dK_MMCCH-2 (K) | 956 |
| 48 | 1097 | 1110 | 999.9612 | 1997.9078 | 1997.9054 | 1.20 | G | 1 | 23 | 0.0049 | TNPFHHGKITHENE +dK_MMCCH-2 (K) | 1104 |
| 49 | 1376 | 1396 | 648.5447 | 2590.1496 | 2590.1428 | 2.63 | G | 3 | 22 | 0.0066 | AGTDSAHTDDGHTEPVMIRKD +dK_MMCCH-2 (K) | 1395 |
| 50 | 1397 | 1413 | 774.4365 | 2320.2876 | 2320.2824 | 2.20 | G | 1 | 14 | 0.044 | ITQLDKRQQLSLVKALE +dK_MMCCH-2 (K) | 1402 |
| 51 | 1397 | 1413 | 774.4338 | 2320.2797 | 2320.2824 | -1.16 | G | 1 | 29 | 0.0011 | ITQLDKRQQLSLVKALE +dK_MMCCH-2 (K) | 1410 |
| 52 | 1495 | 1522 | 1155.5880 | 3463.7422 | 3463.7221 | 5.80 | G | 3 | 20 | 0.0096 | LLTVSTIHDPETGRDIPNPFIGSKIEFE +Deamidated (NQ); dK_MMCCH-2 (K) | 1518 |
| 53 | 1755 | 1765 | 570.6062 | 1708.7968 | 1708.7913 | 3.22 | G | 2 | 37 | 0.0002 | TLDKMNLRHDE +dK_MMCCH-2 (K) | 1758 |
| 54 | 2089 | 2100 | 854.4081 | 1706.8016 | 1706.8008 | 0.53 | G | 2 | 41 | 8.90E-05 | IGGMNLHEIEKE +dK_MMCCH-2 (K) | 2099 |
| 55 | 2624 | 2646 | 637.9164 | 3184.5458 | 3184.5373 | 2.67 | G | 4 | 14 | 0.036 | KHHEDHHEDILVRKNIHSLSHHE +dK_MMCCH-2 (K) | 2624 |
| 56 | 2647 | 2661 | 715.6800 | 2144.0181 | 2144.0095 | 4.01 | G | 4 | 22 | 0.0066 | AEELRDALYKLQNDE +dK_MMCCH-2 (K) | 2656 |
| 57 | 3090 | 3097 | 632.8043 | 1263.5940 | 1263.5879 | 4.75 | G | 0 | 16 | 0.027 | LGKMYSVE +dK_MMCCH-2 (K) | 3092 |
| 58 | 59 | 68 | 729.3447 | 1456.6749 | 1456.6731 | 1.24 | C | 1 | 30 | 0.00091 | VLGGPSEMKW +dK_MMCCH-2 (K); Oxidation (M) | 67 |
| 59 | 160 | 177 | 828.0412 | 2481.1018 | 2481.0907 | 4.47 | C | 2 | 14 | 0.043 | HKFQEDRSVDGYQATAEY +dK_MMCCH-2 (K) | 161 |
| 60 | 587 | 595 | 638.8013 | 1275.5880 | 1275.5805 | 5.88 | C | 0 | 33 | 0.00052 | KEDKSAGGF +dK_MMCCH-2 (K) | 590 |
| 61 | 715 | 723 | 655.8733 | 1309.7320 | 1309.7316 | 0.38 | C | 1 | 23 | 0.0056 | TSIAKQVLL +dK_MMCCH-2 (K) | 719 |
| 62 | 783 | 788 | 544.7773 | 1087.5400 | 1087.5372 | 2.57 | C | 1 | 30 | 0.0011 | QALQKY +dK_MMCCH-2 (K) | 787 |
| 63 | 830 | 838 | 743.3416 | 1484.6687 | 1484.6646 | 2.76 | C | 2 | 13 | 0.047 | NVFDYKTNF +dK_MMCCH-2 (K) | 835 |
| 64 | 860 | 868 | 716.3497 | 1430.6848 | 1430.6864 | -1.12 | C | 0 | 14 | 0.038 | EAIKSQDRF +dK_MMCCH-2 (K) | 863 |

Figure 29 continued

| # | | | | | | | | | | | | |
|---|---|---|---|---|---|---|---|---|---|---|---|---|
| 65 | 944 | 955 | 821.4307 | 1640.8469 | 1640.8484 | -0.91 | C | 3 | 20 | 0.011 | DLKPASLGKDLF+dK_MMCCH-2 (K) | 946 |
| 66 | 1330 | 1337 | 620.3547 | 1238.6949 | 1238.6944 | 0.40 | C | 1 | 22 | 0.007 | KLDITKAL+dK_MMCCH-2 (K) | 1335 |
| 67 | 1431 | 1446 | 696.3586 | 2086.0541 | 2086.0492 | 2.35 | C | 1 | 16 | 0.026 | HALPPLCPSPAASKRF+dK_MMCCH-2 (K) | 1444 |
| 68 | 1580 | 1586 | 544.2616 | 1086.5086 | 1086.5056 | 2.85 | C | 0 | 17 | 0.02 | VGGKEPY+dK_MMCCH-2 (K) | 1583 |
| 69 | 1818 | 1827 | 753.3703 | 1504.7260 | 1504.7232 | 1.93 | C | 1 | 22 | 0.0062 | SERDIGSLKY+dK_MMCCH-2 (K) | 1826 |
| 70 | 2076 | 2082 | 612.3033 | 1222.5920 | 1222.5944 | -1.96 | C | 3 | 14 | 0.037 | KYELLGY+dK_MMCCH-2 (K) | 2076 |
| 71 | 2476 | 2488 | 923.9218 | 1845.8291 | 1845.8244 | 2.55 | C | 1 | 17 | 0.02 | THSNAKPTDVFEY+dK_MMCCH-2 (K) | 2481 |
| 72 | 2656 | 2666 | 793.3524 | 1584.6902 | 1584.6879 | 1.45 | C | 1 | 24 | 0.0045 | KLQNDESHGGY+dK_MMCCH-2 (K) | 2656 |
| 73 | 2964 | 2971 | 607.2731 | 1212.5317 | 1212.5307 | 0.82 | C | 0 | 13 | 0.047 | GGAKEMPW+dK_MMCCH-2 (K) | 2967 |
| 74 | 1 | 9 | 725.3336 | 1448.6526 | 1448.6567 | -2.90 | Th | 2 | 28 | 0.0015 | MTPEELKTY+dK_MMCCH-2 (K) | 7 |
| 75 | 38 | 56 | 861.6798 | 2582.0174 | 2582.0108 | 2.56 | Th | 2 | 19 | 0.013 | VCIPDDNDRNDDHCEKAGD+dK_MMCCH-2 (K) | 53 |
| 76 | 59 | 69 | 785.3771 | 1568.7397 | 1568.7367 | 1.91 | Th | 3 | 54 | 3.80E-06 | VLGGPSEMKWQ+dK_MMCCH-2 (K) | 67 |
| 77 | 78 | 84 | 569.2875 | 1136.5604 | 1136.5536 | 5.98 | Th | 1 | 52 | 6.40E-06 | LSDTVHK+dK_MMCCH-2 (K) | 84 |
| 78 | 118 | 124 | 571.2795 | 1140.5444 | 1140.5386 | 5.09 | Th | 0 | 24 | 0.0042 | VHHPEKG+dK_MMCCH-2 (K) | 123 |
| 79 | 431 | 439 | 707.8488 | 1413.6831 | 1413.6883 | -3.75 | Th | 3 | 19 | 0.012 | ISLENIEKM+dK_MMCCH-2 (K) | 438 |
| 80 | 521 | 530 | 707.8455 | 1413.6765 | 1413.6698 | 4.74 | Th | 2 | 57 | 2.00E-06 | VDITEVDGTK+dK_MMCCH-2 (K) | 530 |
| 81 | 585 | 591 | 585.8103 | 1169.6060 | 1169.6002 | 5.04 | Th | 1 | 25 | 0.0029 | LLKEDKS+dK_MMCCH-2 (K) | 590 |
| 82 | 601 | 612 | 904.8980 | 1807.7813 | 1807.7698 | 6.36 | Th | 1 | 21 | 0.0084 | FHGEPKWCPSPE+dK_MMCCH-2 (K) | 606 |
| 83 | 666 | 672 | 607.2825 | 1212.5505 | 1212.5485 | 1.65 | Th | 2 | 25 | 0.0034 | LADHEKY+dK_MMCCH-2 (K) | 671 |
| 84 | 831 | 837 | 612.7867 | 1223.5589 | 1223.5533 | 4.66 | Th | 2 | 28 | 0.0017 | VFDYKTN+dK_MMCCH-2 (K) | 835 |
| 85 | 1219 | 1232 | 766.6623 | 2296.9650 | 2296.9617 | 1.48 | Th | 1 | 15 | 0.034 | FDKSDNNDEATKTH+2 dK_MMCCH-2 (K) | 1221, 1230 |
| 86 | 1580 | 1587 | 572.7716 | 1143.5287 | 1143.5271 | 1.40 | Th | 1 | 17 | 0.019 | VGGKEPYG+dK_MMCCH-2 (K) | 1583 |
| 87 | 1657 | 1668 | 921.9177 | 1841.8208 | 1841.8182 | 1.41 | Th | 2 | 35 | 0.00035 | FSKPEDTFDYQK+dK_MMCCH-2 (K) | 1659 |

Figure 29 continued

| | | | | | | | | | |
|---|---|---|---|---|---|---|---|---|---|
| 88 | 1657 | 921.9194 | 1841.8242 | 1841.8182 | 3.26 | Th | 2 | 30 | 0.00099 | FSKPEDTFDYQK +dK_MMCCH-2 (K) | 1668 |
| 89 | 1733 | 664.3220 | 1326.6294 | 1326.6312 | -1.36 | Th | 2 | 18 | 0.015 | VLGGEKEMP +dK_MMCCH-1 (K); Oxidation (M) | 1738 |
| 90 | 1894 | 850.4149 | 1698.8152 | 1698.8116 | 2.12 | Th | 5 | 39 | 0.00012 | VAVPYWDWTKP +dK_MMCCH-2 (K) | 1903 |
| 91 | 2064 | 499.7595 | 997.5045 | 997.5055 | -1.00 | Th | 0 | 20 | 0.011 | FTKKH +dK_MMCCH-2 (K) | 2067 |
| 92 | 2094 | 618.3040 | 1234.5934 | 1234.5903 | 2.43 | Th | 1 | 20 | 0.0093 | LHEIEKE +dK_MMCCH-2 (K) | 2099 |
| 93 | 2129 | 622.9255 | 1865.7546 | 1865.7495 | 2.73 | Th | 0 | 19 | 0.014 | ICKTSEDCHHGGQ +dK_MMCCH-2 (K) | 2131 |
| 94 | 2238 | 778.8811 | 1555.7476 | 1555.7440 | 2.38 | Th | 3 | 23 | 0.0051 | LTTAEVDNLKD +dK_MMCCH-2 (K) | 2247 |
| 95 | 2480 | 825.8984 | 1649.7822 | 1649.7759 | 3.82 | Th | 3 | 26 | 0.0024 | AKPTDVFEYSR +dK_MMCCH-2 (K) | 2481 |
| 96 | 2512 | 538.6002 | 1612.7787 | 1612.7766 | 1.24 | Th | 0 | 39 | 0.00013 | LEKQKEEDRT +dK_MMCCH-2 (K) | 2514 |
| 97 | 2512 | 807.3967 | 1612.7788 | 1612.7766 | 1.30 | Th | 0 | 20 | 0.0096 | LEKQKEEDRT +dK_MMCCH-2 (K) | 2516 |
| 98 | 2595 | 806.4067 | 1610.7988 | 1610.7862 | 7.82 | Th | 2 | 38 | 0.00017 | IIDTSGKQLPSD +dK_MMCCH-2 (K) | 2601 |
| 99 | 2607 | 520.7801 | 1039.5456 | 1039.5446 | 0.96 | Th | 2 | 23 | 0.0052 | LIKMPT +dK_MMCCH-2 (K) | 2609 |
| 100 | 2766 | 551.7874 | 1101.5603 | 1101.5529 | 6.72 | Th | 1 | 36 | 0.00025 | IFQQTK +dK_MMCCH-2 (K) | 2771 |
| 101 | 2808 | 638.3197 | 1274.6248 | 1274.6217 | 2.51 | Th | 3 | 28 | 0.0017 | LIGGAEKYS +dK_MMCCH-2 (K) | 2814 |
| 102 | 2946 | 965.4082 | 1928.8018 | 1928.7986 | 1.66 | Th | 3 | 34 | 0.00039 | IKSGTDSDDEYAGSF +dK_MMCCH-2 (K) | 2947 |
| 103 | 2990 | 583.2842 | 1164.5539 | 1164.5485 | 4.64 | Th | 1 | 38 | 0.00014 | LTDHVK +dK_MMCCH-2 (K) | 2996 |

Figure 29 continued

| # | Start | End | Observed | Mr(expt) | Mr(calc) | ppm | Enzyme | MC | Score | E value | Peptide | Mod_site |
|---|---|---|---|---|---|---|---|---|---|---|---|---|
| 1 | 26 | 41 | 1043.0233 | 2084.0321 | 2084.0347 | -1.25 | T | 1 | 56 | 2.30E-06 | KNVDSLSSDEVLALEK +dK_MMCCH-2 (K) | 26 |
| 2 | 147 | 155 | 694.3710 | 1386.7274 | 1386.7217 | 4.11 | T | 1 | 32 | 0.00062 | ADITFLNKK +dK_MMCCH-2 (K) | 155 |
| 3 | 164 | 175 | 596.3118 | 1785.9135 | 1785.8985 | 8.40 | T | 1 | 41 | 8.70E-05 | LFEKVQPGHHTR +dK_MMCCH-2 (K) | 167 |
| 4 | 249 | 271 | 987.4451 | 2959.3136 | 2959.3051 | 2.84 | T | 1 | 25 | 0.003 | GKDPNSADCAHNLJHTPMEPFDR +dK_MMCCH-2 (K) | 250 |
| 5 | 281 | 293 | 610.9456 | 1829.8150 | 1829.8043 | 5.90 | T | 1 | 54 | 3.60E-06 | EHAKPADSFDYGR +dK_MMCCH-2 (K) | 284 |
| 6 | 419 | 446 | 846.4617 | 3381.8176 | 3381.8132 | 1.30 | T | 1 | 26 | 0.0025 | QPTLVHRPAKGHFDKPPVPVAQANLAVR +Deamidated (NQ); dK_MMCCH-2 (K) | 428 |
| 7 | 429 | 446 | 752.0691 | 2253.1854 | 2253.1729 | 5.59 | T | 0 | 50 | 9.70E-06 | GHFDKPPVPVAQANLAVR +dK_MMCCH-2 (K) | 433 |
| 8 | 467 | 488 | 944.4572 | 2830.3498 | 2830.3385 | 3.99 | T | 1 | 65 | 2.90E-07 | FQNDKSVDGYQATVEFHALPAR +dK_MMCCH-2 (K) | 471 |
| 9 | 489 | 497 | 484.8979 | 1451.6719 | 1451.6649 | 4.82 | T | 1 | 14 | 0.039 | CPRPDAKDR +dK_MMCCH-2 (K) | 495 |
| 10 | 936 | 950 | 720.3440 | 2158.0101 | 2158.0095 | 0.32 | T | 1 | 32 | 0.0007 | KHGFTGGLPYWDWTR +dK_MMCCH-2 (K) | 936 |
| 11 | 1082 | 1096 | 996.4645 | 1990.9144 | 1990.9063 | 4.07 | T | 0 | 77 | 1.80E-08 | GKPYNTANCAIASMR +dK_MMCCH-2 (K) | 1083 |
| 12 | 1097 | 1115 | 827.0785 | 2478.2138 | 2478.2101 | 1.49 | T | 0 | 66 | 2.50E-07 | KPLQPFGLDSVINPDDETR +dK_MMCCH-2 (K) | 1097 |
| 13 | 1123 | 1149 | 1190.5604 | 3568.6594 | 3568.6497 | 2.75 | T | 1 | 68 | 1.70E-07 | VFDYKNNFDYEYESLAFNGLSIAQLDR +dK_MMCCH-2 (K) | 1127 |
| 14 | 1295 | 1311 | 764.0680 | 2289.1821 | 2289.1715 | 4.67 | T | 1 | 13 | 0.05 | SAFLQIQKEGIYENIAK +dK_MMCCH-2 (K) | 1302 |
| 15 | 1355 | 1385 | 1271.2700 | 3810.7882 | 3810.7876 | 0.18 | T | 1 | 27 | 0.0022 | GSAVAVPYWDWTEKADSLPSLINDATYFNSR +dK_MMCCH-2 (K) | 1368 |
| 16 | 1409 | 1450 | 1371.8911 | 5483.5353 | 5483.5213 | 2.55 | T | 1 | 17 | 0.022 | DPQPELWDNKDFYENVMLALEQDNFCDFEIQLEUHNALHSR +dK_MMCCH-2 (K) | 1418 |
| 17 | 1455 | 1480 | 1117.8834 | 3350.6284 | 3350.6070 | 6.39 | T | 1 | 40 | 0.00011 | AKYSLSLDYTAFDPVFFLHHANVDR +dK_MMCCH-2 (K) | 1456 |
| 18 | 1493 | 1507 | 721.6597 | 2161.9574 | 2161.9594 | -0.97 | T | 1 | 55 | 3.20E-06 | KKPYNEADCAVNEMR +dK_MMCCH-2 (K) | 1494 |

Figure 29 continued

| | | | | | | | | | |
|---|---|---|---|---|---|---|---|---|---|
| 19 | 1542 | 1564 | 802.8948 | 3207.5503 | 3207.5448 | 1.71 | T | 1 | 30 | 0.00094 | YQYDNLQFNHFSICKLDQTIQAR +dK_MMCCH-2 (K) | 1556 |
| 20 | 1622 | 1633 | 591.9822 | 1772.9247 | 1772.9171 | 4.29 | T | 1 | 23 | 0.0047 | LYKFDITSALHK +dK_MMCCH-2 (K) | 1624 |
| 21 | 1690 | 1704 | 532.2889 | 2125.1267 | 2125.1241 | 1.18 | T | 2 | 21 | 0.0085 | KEVSSLTTLEKHFLR +dK_MMCCH-2 (K) | 1700 |
| 22 | 1949 | 1963 | 560.2532 | 2236.9836 | 2236.9735 | 4.47 | T | 0 | 46 | 2.30E-05 | TQEFSKPEDTFDYHR +dK_MMCCH-2 (K) | 1954 |
| 23 | 2400 | 2404 | 479.2446 | 956.4746 | 956.4749 | -0.42 | T | 1 | 14 | 0.043 | KSQTR +dK_MMCCH-2 (K) | 2400 |
| 24 | 2527 | 2541 | 1007.5180 | 2013.0215 | 2013.0088 | 6.26 | T | 1 | 69 | 1.40E-07 | KDVTSLTASEIENLR +dK_MMCCH-2 (K) | 2527 |
| 25 | 2728 | 2739 | 958.0043 | 1913.9941 | 1913.9862 | 4.13 | T | 1 | 15 | 0.03 | IWAIWQALQKYR +Deamidated (NQ); dK_MMCCH-2 (K) | 2737 |
| 26 | 2755 | 2764 | 764.3857 | 1526.7569 | 1526.7439 | 8.51 | T | 0 | 34 | 0.00043 | QPLKPFSESR +Deamidated (NQ); dK_MMCCH-2 (K) | 2758 |
| 27 | 41 | 49 | 692.3309 | 1382.6472 | 1382.6388 | 6.08 | T | 2 | 20 | 0.01 | KALDDLQQD +dK_MMCCH-2 (K) | 41 |
| 28 | 167 | 178 | 590.9647 | 1769.8723 | 1769.8705 | 1.02 | G | 0 | 24 | 0.0036 | KVQPGHHTRLME +dK_MMCCH-2 (K) | 167 |
| 29 | 318 | 322 | 456.7346 | 911.4547 | 911.4535 | 1.43 | G | 0 | 18 | 0.018 | RAAKE +dK_MMCCH-2 (K) | 321 |
| 30 | 433 | 456 | 975.8574 | 2924.5504 | 2924.5429 | 2.56 | G | 2 | 21 | 0.0074 | KPPVPVAQANLAVRKNINDLTAEE +dK_MMCCH-2 (K) | 433 |
| 31 | 466 | 481 | 1098.5017 | 2194.9889 | 2194.9841 | 2.19 | G | 2 | 36 | 0.00023 | RFQNDKSVDGYQATVE +Deamidated (NQ); dK_MMCCH-2 (K) | 471 |
| 32 | 1117 | 1135 | 1404.1268 | 2806.2391 | 2806.2373 | 0.64 | G | 3 | 17 | 0.021 | HSVPFRVFDYKNNFDYEYE +dK_MMCCH-2 (K) | 1127 |
| 33 | 1215 | 1235 | 961.8077 | 2882.4014 | 2882.3949 | 2.26 | G | 3 | 40 | 9.80E-05 | ITQQLHDLDLHVGDNFFLKYE +dK_MMCCH-2 (K) | 1233 |
| 34 | 1292 | 1303 | 879.4660 | 1756.9174 | 1756.9182 | -0.40 | G | 3 | 44 | 4.30E-05 | SIRSAFLQIQKE +dK_MMCCH-2 (K) | 1302 |
| 35 | 1308 | 1320 | 904.9468 | 1807.8791 | 1807.8749 | 2.32 | G | 0 | 22 | 0.0066 | NIAKFHGKPGLCE +dK_MMCCH-2 (K) | 1311 |
| 36 | 1308 | 1320 | 904.9480 | 1807.8814 | 1807.8749 | 3.60 | G | 0 | 34 | 0.00036 | NIAKFHGKPGLCE +dK_MMCCH-2 (K) | 1315 |
| 37 | 1354 | 1378 | 1043.5093 | 3127.5060 | 3127.4961 | 3.17 | G | 3 | 16 | 0.022 | RGSAVAPYWDWTEKADSLPSLIND +dK_MMCCH-2 (K) | 1368 |
| 38 | 1403 | 1422 | 921.4252 | 2761.2537 | 2761.2330 | 7.50 | G | 3 | 17 | 0.018 | NAVTSRDPQPELWDNKDFYE +dK_MMCCH-2 (K) | 1418 |
| 39 | 1952 | 1967 | 792.6834 | 2375.0284 | 2375.0205 | 3.33 | G | 3 | 34 | 0.00036 | FSKPEDTFDYHRFGYE +dK_MMCCH-2 (K) | 1954 |
| 40 | 1973 | 1990 | 811.7261 | 2432.1566 | 2432.1505 | 2.51 | G | 0 | 24 | 0.0037 | FVGMSVSSLHNYIKQQQE +dK_MMCCH-2 (K) | 1986 |
| 41 | 2475 | 2484 | 752.8744 | 1503.7342 | 1503.7320 | 1.53 | G | 1 | 19 | 0.013 | TDAPFFIKVE +dK_MMCCH-2 (K) | 2482 |

Figure 29 continued

| | | | | | | | | | | |
|---|---|---|---|---|---|---|---|---|---|---|
| 42 | 3386 | 3405 | 658.3157 | 2629.2338 | 2629.2271 | 2.55 | G | 2 | 22 | 0.007 | LDHAYSLRDGHYYIAGPTKD +dK_MMCCH-2 (K) | 3404 |
| 43 | 277 | 296 | 883.7536 | 2648.2390 | 2648.2329 | 2.27 | C | 4 | 35 | 0.00034 | DLTREHAKPADSFDYGRLGY +dK_MMCCH-2 (K) | 284 |
| 44 | 629 | 635 | 539.2529 | 1076.4913 | 1076.4848 | 6.04 | C | 0 | 21 | 0.0076 | VGGSEKY +dK_MMCCH-2 (K) | 634 |
| 45 | 1007 | 1015 | 669.8713 | 1337.7280 | 1337.7265 | 1.12 | C | 1 | 27 | 0.0021 | TDIAKQVL +dK_MMCCH-2 (K) | 1011 |
| 46 | 1075 | 1080 | 544.7773 | 1087.5400 | 1087.5372 | 2.57 | C | 1 | 30 | 0.0011 | QALQKY +dK_MMCCH-2 (K) | 1079 |
| 47 | 1298 | 1306 | 715.3745 | 1428.7343 | 1428.7323 | 1.47 | C | 1 | 14 | 0.045 | LQIQKEGIY +dK_MMCCH-2 (K) | 1302 |
| 48 | 1589 | 1606 | 784.3547 | 2350.0422 | 2350.0392 | 1.28 | C | 0 | 22 | 0.0068 | ICVEQGGEQNCKTKAGSF +dK_MMCCH-2 (K) | 1602 |
| 49 | 1696 | 1702 | 607.3019 | 1212.5892 | 1212.5849 | 3.55 | C | 1 | 23 | 0.0054 | TTLEKHF +dK_MMCCH-2 (K) | 1700 |
| 50 | 1782 | 1796 | 1014.5057 | 2026.9968 | 2026.9921 | 2.32 | C | 1 | 14 | 0.041 | KPQSALPDLVTQETY +dK_MMCCH-2 (K) | 1782 |
| 51 | 1801 | 1809 | 706.8389 | 1411.6632 | 1411.6595 | 2.62 | C | 0 | 15 | 0.033 | SHKTFPNPF +dK_MMCCH-2 (K) | 1803 |
| 52 | 1985 | 1995 | 850.4291 | 1698.8436 | 1698.8399 | 2.18 | C | 0 | 31 | 0.00089 | IKQQQEADRVF +dK_MMCCH-2 (K) | 1986 |
| 53 | 2001 | 2011 | 726.8444 | 1451.6743 | 1451.6755 | -0.83 | C | 1 | 34 | 0.00042 | KGFGQSASVSF +dK_MMCCH-2 (K) | 2001 |
| 54 | 2455 | 2462 | 645.3267 | 1288.6388 | 1288.6373 | 1.16 | C | 1 | 21 | 0.0078 | KYDITQAL +dK_MMCCH-2 (K) | 2455 |
| 55 | 2463 | 2479 | 752.3476 | 2254.0210 | 2254.0253 | -1.91 | C | 1 | 14 | 0.037 | KAQSIHPEDVFDTDAPF +dK_MMCCH-2 (K) | 2463 |
| 56 | 2754 | 2760 | 598.3323 | 1194.6501 | 1194.6471 | 2.51 | C | 1 | 14 | 0.04 | KQPLKPF +dK_MMCCH-2 (K) | 2758 |
| 57 | 2865 | 2872 | 673.3655 | 1344.7164 | 1344.7112 | 3.94 | C | 1 | 14 | 0.041 | RYDITKVL +dK_MMCCH-2 (K) | 2870 |
| 58 | 3235 | 3242 | 617.3137 | 1232.6129 | 1232.6111 | 1.46 | C | 0 | 29 | 0.0014 | TSANVKIY +dK_MMCCH-2 (K) | 3240 |
| 59 | 3399 | 3406 | 576.8031 | 1151.5916 | 1151.5896 | 1.74 | C | 0 | 19 | 0.014 | IAGPTKDL +dK_MMCCH-2 (K) | 3404 |
| 60 | 69 | 75 | 604.2934 | 1206.5722 | 1206.5703 | 1.66 | Th | 0 | 17 | 0.022 | VDKHEKN +dK_MMCCH-2 (K) | 74 |
| 61 | 165 | 175 | 558.6143 | 1672.8211 | 1672.8144 | 4.01 | Th | 1 | 13 | 0.048 | FEKVQPGHHTR +dK_MMCCH-2 (K) | 167 |
| 62 | 181 | 191 | 853.3782 | 1704.7419 | 1704.7375 | 2.58 | Th | 3 | 58 | 1.60E-06 | LDALEQDEFCK +dK_MMCCH-2 (K) | 191 |
| 63 | 247 | 257 | 785.8571 | 1569.6996 | 1569.6916 | 5.10 | Th | 1 | 13 | 0.046 | LRGKDPNSADC +dK_MMCCH-2 (K) | 250 |
| 64 | 278 | 293 | 734.3531 | 2200.0374 | 2200.0371 | 0.14 | Th | 4 | 26 | 0.0027 | LTREHAKPADSFDYGR +dK_MMCCH-2 (K) | 284 |

Figure 29 continued

| | | | | | | | | | | |
|---|---|---|---|---|---|---|---|---|---|---|
| 65 | 365 | 372 | 585.7806 | 1169.5466 | 1169.5461 | 0.43 | Th | 1 | 50 | 9.10E-06 | LGGPTEMK +dK_MMCCH-2 (K) | 372 |
| 66 | 431 | 437 | 569.2895 | 1136.5644 | 1136.5576 | 5.98 | Th | 1 | 16 | 0.025 | FDKPPVP +dK_MMCCH-2 (K) | 433 |
| 67 | 629 | 636 | 582.7663 | 1163.5180 | 1163.5169 | 1.03 | Th | 1 | 31 | 0.00077 | VGGSEKYS +dK_MMCCH-2 (K) | 634 |
| 68 | 893 | 904 | 904.8980 | 1807.7813 | 1807.7698 | 6.36 | Th | 1 | 21 | 0.0084 | FHGEPKWCPSPF +dK_MMCCH-2 (K) | 898 |
| 69 | 1123 | 1129 | 619.2853 | 1236.5560 | 1236.5485 | 6.07 | Th | 2 | 18 | 0.014 | VFDYKNN +dK_MMCCH-2 (K) | 1127 |
| 70 | 1414 | 1419 | 564.7562 | 1127.4979 | 1127.4957 | 1.95 | Th | 1 | 17 | 0.021 | LWDNKD +dK_MMCCH-2 (K) | 1418 |
| 71 | 1525 | 1539 | 738.3549 | 2212.0428 | 2212.0371 | 2.53 | Th | 3 | 36 | 0.00024 | LKHNLPQDSFDYQNR +dK_MMCCH-2 (K) | 1526 |
| 72 | 1589 | 1605 | 735.3313 | 2202.9721 | 2202.9708 | 0.59 | Th | 2 | 15 | 0.028 | ICVEQGGEQNCKTKAGS +dK_MMCCH-2 (K) | 1600 |
| 73 | 1589 | 1605 | 735.3325 | 2202.9757 | 2202.9708 | 2.27 | Th | 2 | 39 | 0.00013 | ICVEQGGEQNCKTKAGS +dK_MMCCH-2 (K) | 1602 |
| 74 | 1800 | 1809 | 780.3741 | 1558.7337 | 1558.7279 | 3.79 | Th | 2 | 18 | 0.016 | FSHKTFPNPF +dK_MMCCH-2 (K) | 1803 |
| 75 | 1952 | 1963 | 627.2840 | 1878.8302 | 1878.8247 | 2.93 | Th | 2 | 44 | 3.90E-05 | FSKPEDTFDYHR +dK_MMCCH-2 (K) | 1954 |
| 76 | 1985 | 1994 | 776.8959 | 1551.7772 | 1551.7715 | 3.67 | Th | 2 | 22 | 0.0064 | IKQQQEADRV +dK_MMCCH-2 (K) | 1986 |
| 77 | 2193 | 2199 | 667.3012 | 1332.5877 | 1332.5849 | 2.10 | Th | 2 | 25 | 0.0034 | YWDWTKP +dK_MMCCH-2 (K) | 2198 |
| 78 | 2200 | 2206 | 562.3086 | 1122.6026 | 1122.5995 | 2.85 | Th | 2 | 22 | 0.0062 | ISKLPDL +dK_MMCCH-2 (K) | 2202 |
| 79 | 2225 | 2229 | 462.2211 | 922.4277 | 922.4259 | 1.95 | Th | 2 | 23 | 0.0053 | FAKGY +dK_MMCCH-2 (K) | 2227 |
| 80 | 2230 | 2237 | 632.7936 | 1263.5726 | 1263.5693 | 2.61 | Th | 2 | 14 | 0.045 | IKSEDAVT +dK_MMCCH-2 (K) | 2231 |
| 81 | 2359 | 2363 | 509.2314 | 1016.4482 | 1016.4460 | 2.16 | Th | 1 | 26 | 0.0026 | FTKMH +dK_MMCCH-2 (K); Oxidation (M) | 2361 |
| 82 | 2941 | 2950 | 720.8408 | 1439.6670 | 1439.6602 | 4.72 | Th | 3 | 45 | 3.20E-05 | LDEANDLKNA +dK_MMCCH-2 (K) | 2948 |
| 83 | 3009 | 3015 | 573.2776 | 1144.5307 | 1144.5335 | -2.45 | Th | 0 | 14 | 0.043 | LKEHGSH +dK_MMCCH-2 (K) | 3010 |
| 84 | 3399 | 3405 | 520.2607 | 1038.5069 | 1038.5056 | 1.25 | Th | 1 | 25 | 0.0029 | IAGPTKD +dK_MMCCH-2 (K) | 3404 |

"Start" and "End" indicates the number of residue of KLH1 or KLH2. "Observed" column implies the observed m/z value in the survey scan while "Mr(expt)", "Mr(calc)", "ppm" indicate the experimental molecular weight(MW), calculated MW, and the difference between observed MW and theoretical MW

Figure 29 continued

Figure 29 continued respectively. In the "Enzyme" column, T, C, G and Th stand for trypsin, chymotrypsin, Glu-C and thermolysin respectively. MC stands for missed cleavage. Scores are the peptide ion score directly reported from Mascot database search engine. E value denotes the expectation value for each identified peptide. The peptide sequences as well as its modifications are listed in "Peptide" column. "Mod_site" indicates the lysine conjugation site for KLH1 or KLH2.

Figure 30

| # | K site | sample 1 | sample 2 | sample 3 | sample 4 | # | K site | sample 1 | sample 2 | sample 3 | sample 4 | # | K site | sample 1 | sample 2 | sample 3 | sample 4 | # | K site | sample 1 | sample 2 | sample 3 | sample 4 |
|---|---|---|---|---|---|---|---|---|---|---|---|---|---|---|---|---|---|---|---|---|---|---|---|
| 1 | K 7 | | | | | 51 | K 879 | | | | | 101 | K 2033 | | | | | 151 | K 3044 | | | | |
| 2 | K 26 | | | | | 52 | K 884 | | | | | 102 | K 2066 | | | | | 152 | K 3048 | | | | |
| 3 | K 53 | | | | | 53 | K 918 | | | | | 103 | K 2067 | | | | | 153 | K 3052 | | | | |
| 4 | K 67 | | | | | 54 | K 924 | | | | | 104 | K 2076 | | | | | 154 | K 3077 | | | | |
| 5 | K 84 | | | | | 55 | K 929 | | | | | 105 | K 2099 | | | | | 155 | K 3079 | | | | |
| 6 | K 88 | | | | | 56 | K 946 | | | | | 106 | K 2102 | | | | | 156 | K 3092 | | | | |
| 7 | K 96 | | | | | 57 | K 952 | | | | | 107 | K 2104 | | | | | | total | 14 | 7 | 4 | 8 |
| 8 | K 123 | | | | | 58 | K 956 | O | O | | O | 108 | K 2131 | | | | | | | | | | |
| 9 | K 131 | | | | | 59 | K 986 | O | | | | 109 | K 2149 | | | | | | | | | | |
| 10 | K 142 | O | | | | 60 | K 1017 | | | | | 110 | K 2160 | | | | | | | | | | |
| 11 | K 161 | O | | | | 61 | K 1059 | | | | | 111 | K 2187 | | | | | | | | | | |
| 12 | K 190 | | | | | 62 | K 1060 | | | | | 112 | K 2233 | | | | | | | | | | |
| 13 | K 251 | | | | | 63 | K 1073 | | | | | 113 | K 2247 | | O | O | O | | | | | | |
| 14 | K 280 | | | | | 64 | K 1104 | O | O | O | O | 114 | K 2281 | | | | | | | | | | |
| 15 | K 289 | | | | | 65 | K 1117 | | | | | 115 | K 2302 | | | | | | | | | | |
| 16 | K 373 | | | | | 66 | K 1160 | | | | | 116 | K 2360 | O | | | O | | | | | | |
| 17 | K 389 | | | | | 67 | K 1162 | | | | | 117 | K 2460 | | | | | | | | | | |
| 18 | K 402 | | | O | O | 68 | K 1199 | | | | | 118 | K 2481 | | | | | | | | | | |
| 19 | K 411 | | | | | 69 | K 1221 | | | | | 119 | K 2506 | | | | | | | | | | |
| 20 | K 438 | | | | | 70 | K 1230 | | | | | 120 | K 2507 | | | | | | | | | | |
| 21 | K 469 | | | | | 71 | K 1270 | | | | | 121 | K 2514 | | | | | | | | | | |
| 22 | K 477 | | | | | 72 | K 1303 | | | | | 122 | K 2516 | | | | | | | | | | |
| 23 | K 488 | | | | | 73 | K 1330 | | | | | 123 | K 2531 | | | | | | | | | | |
| 24 | K 491 | | | | | 74 | K 1335 | | | | | 124 | K 2532 | | | | | | | | | | |
| 25 | K 499 | | | | | 75 | K 1338 | | | | | 125 | K 2579 | | | | | | | | | | |
| 26 | K 507 | | | | O | 76 | K 1339 | | | | | 126 | K 2601 | | | | | | | | | | |
| 27 | K 530 | | | | | 77 | K 1395 | | | | | 127 | K 2609 | | | | | | | | | | |
| 28 | K 549 | | | | | 78 | K 1402 | | | | | 128 | K 2620 | | | | | | | | | | |
| 29 | K 554 | | | | | 79 | K 1410 | | | | | 129 | K 2624 | | | | | | | | | | |
| 30 | K 557 | | | | | 80 | K 1416 | | | | | 130 | K 2637 | | | | | | | | | | |
| 31 | K 566 | | | | | 81 | K 1444 | | | | | 131 | K 2656 | | | | | | | | | | |
| 32 | K 581 | | | | | 82 | K 1473 | O | | | | 132 | K 2682 | | | | | | | | | | |
| 33 | K 587 | | | | | 83 | K 1518 | | | | | 133 | K 2686 | | | | | | | | | | |
| 34 | K 590 | O | O | | | 84 | K 1529 | | | | | 134 | K 2713 | | | | | | | | | | |
| 35 | K 606 | | | | | 85 | K 1543 | | | | | 135 | K 2714 | | | | | | | | | | |
| 36 | K 615 | | | | | 86 | K 1583 | | | | | 136 | K 2748 | | | | | | | | | | |
| 37 | K 616 | O | | | | 87 | K 1636 | | | | | 137 | K 2771 | | | | | | | | | | |
| 38 | K 671 | | | | | 88 | K 1640 | | | | | 138 | K 2814 | | | | | | | | | | |
| 39 | K 681 | | | | | 89 | K 1659 | | | | | 139 | K 2838 | | | | | | | | | | |
| 40 | K 695 | | | | | 90 | K 1668 | | | | | 140 | K 2848 | | | | | | | | | | |
| 41 | K 704 | | | | | 91 | K 1738 | | | | | 141 | K 2852 | O | O | O | O | | | | | | |
| 42 | K 719 | O | O | | | 92 | K 1749 | | | | | 142 | K 2900 | O | | | | | | | | | |
| 43 | K 787 | | | | | 93 | K 1758 | | | | | 143 | K 2924 | | | | | | | | | | |
| 44 | K 791 | | | | | 94 | K 1809 | | | | | 144 | K 2943 | | | | | | | | | | |
| 45 | K 823 | | | | | 95 | K 1826 | | | | | 145 | K 2947 | | | | | | | | | | |
| 46 | K 835 | | | | | 96 | K 1853 | | | | | 146 | K 2967 | | | | | | | | | | |
| 47 | K 857 | | | | | 97 | K 1903 | | | | | 147 | K 2996 | | | | | | | | | | |
| 48 | K 858 | | | | | 98 | K 1915 | | | | | 148 | K 3002 | | | | | | | | | | |
| 49 | K 863 | | | | | 99 | K 1924 | O | O | | O | 149 | K 3003 | O | | | | | | | | | |
| 50 | K 878 | | | | | 100 | K 2022 | | | | | 150 | K 3037 | | | | | | | | | | |

| # | K site | sample 1 | sample 2 | sample 3 | sample 4 | # | K site | sample 1 | sample 2 | sample 3 | sample 4 | # | K site | sample 1 | sample 2 | sample 3 | sample 4 |
|---|---|---|---|---|---|---|---|---|---|---|---|---|---|---|---|---|---|
| 1 | K 26 | O | O | | | 51 | K 1127 | O | O | | | 101 | K 2198 | | | | |
| 2 | K 41 | | | | | 52 | K 1155 | | | | | 102 | K 2202 | | | | |
| 3 | K 71 | | | | | 53 | K 1176 | | | | | 103 | K 2227 | | | | |
| 4 | K 74 | | | | | 54 | K 1181 | | | | | 104 | K 2231 | | | | |
| 5 | K 104 | | | | | 55 | K 1212 | | | | | 105 | K 2317 | | | | |
| 6 | K 105 | | | | | 56 | K 1233 | | | | | 106 | K 2327 | | | | |
| 7 | K 138 | | | | | 57 | K 1280 | | | | | 107 | K 2328 | | | | |
| 8 | K 154 | | | | | 58 | K 1302 | O | | | | 108 | K 3330 | | | | |
| 9 | K 155 | | | | | 59 | K 1311 | | | | | 109 | K 2335 | | | | |
| 10 | K 167 | O | O | | O | 60 | K 1315 | | | | | 110 | K 2345 | | | | |
| 11 | K 191 | | | | | 61 | K 1368 | O | | O | | 111 | K 2361 | | | | |
| 12 | K 250 | O | O | | O | 62 | K 1418 | | | | | 112 | K 2400 | | | | |
| 13 | K 284 | O | O | | O | 63 | K 1456 | O | O | | | 113 | K 2426 | | | | |
| 14 | K 321 | | | | | 64 | K 1493 | | | | | 114 | K 2444 | | | | O |
| 15 | K 358 | | | | | 65 | K 1494 | | | | | 115 | K 2455 | | | | |
| 16 | K 372 | | | | | 66 | K 1508 | O | | | | 116 | K 2463 | | O | O | O |
| 17 | K 401 | | | | | 67 | K 1526 | O | O | O | O | 117 | K 2482 | | | | |
| 18 | K 428 | | | | | 68 | K 1556 | | | | | 118 | K 2490 | | | | |
| 19 | K 433 | O | | | O | 69 | K 1565 | | | | | 119 | K 2527 | | | | |
| 20 | K 447 | | | | | 70 | K 1600 | | | | | 120 | K 2596 | | | | |
| 21 | K 462 | | | | | 71 | K 1602 | O | | | | 121 | K 2737 | | | | |
| 22 | K 471 | O | O | | O | 72 | K 1624 | | | | | 122 | K 2754 | | | | |
| 23 | K 495 | | | | | 73 | K 1633 | | | | | 123 | K 2758 | | | | |
| 24 | K 562 | | | | | 74 | K 1646 | | | | | 124 | K 2810 | | | | |
| 25 | K 585 | | | | | 75 | K 1675 | | | | | 125 | K 2811 | | | | |
| 26 | K 589 | | | | | 76 | K 1690 | O | | | | 126 | K 2870 | | | | |
| 27 | K 634 | | | | | 77 | K 1700 | | | | | 127 | K 2873 | | | | |
| 28 | K 672 | | | | | 78 | K 1705 | | | | | 128 | K 2888 | | | | |
| 29 | K 675 | | | | | 79 | K 1708 | | | | | 129 | K 2903 | | | | |
| 30 | K 688 | | | | | 80 | K 1767 | | | | | 130 | K 2934 | | | | |
| 31 | K 701 | | | | | 81 | K 1782 | | | | | 131 | K 2948 | | | | |
| 32 | K 741 | | | | | 82 | K 1803 | | | | | 132 | K 2953 | | | | |
| 33 | K 774 | | | | | 83 | K 1811 | | | | | 133 | K 3010 | | | | |
| 34 | K 776 | | | | | 84 | K 1835 | | | | | 134 | K 3025 | | | | |
| 35 | K 787 | | | | | 85 | K 1879 | | | | | 135 | K 3045 | | | | |
| 36 | K 790 | | | | | 86 | K 1921 | | | | | 136 | K 3050 | | | | |
| 37 | K 798 | | | | | 87 | K 1931 | | | | | 137 | K 3145 | | | | |
| 38 | K 806 | | | | | 88 | K 1935 | | | | | 138 | K 3148 | | | | |
| 39 | K 848 | | | | | 89 | K 1947 | | | | | 139 | K 3149 | | | | |
| 40 | K 855 | | | | | 90 | K 1954 | O | O | O | O | 140 | K 3155 | | | | |
| 41 | K 858 | | | | | 91 | K 1986 | O | O | | O | 141 | K 3184 | | | | |
| 42 | K 882 | | | | | 92 | K 2001 | | | | | 142 | K 3193 | | | | |
| 43 | K 898 | | | | | 93 | K 2044 | | | | | 143 | K 3240 | | | | |
| 44 | K 907 | | | | | 94 | K 2049 | | | | | 144 | K 3263 | | | | |
| 45 | K 908 | | | | | 95 | K 2052 | | | | | 145 | K 3274 | | | | |
| 46 | K 936 | | | | | 96 | K 2055 | | | | | 146 | K 3321 | | | | |
| 47 | K 1011 | | | | | 97 | K 2065 | | | | | 147 | K 3336 | | | | |
| 48 | K 1079 | | | | | 98 | K 2069 | | | | | 148 | K 3340 | | | | |
| 49 | K 1083 | | | | | 99 | K 2092 | | | | | 149 | K 3344 | | | | |
| 50 | K 1097 | O | O | O | O | 100 | K 2171 | | | | | 150 | K 3404 | | | | |
| | | | | | | | | | | | | | total | 17 | 12 | 6 | 10 |

Figure 30 continued

| # | K site | sample 1 | sample 2 | sample 3 | sample 4 | # | K site | sample 1 | sample 2 | sample 3 | sample 4 | # | K site | sample 1 | sample 2 | sample 3 | sample 4 | # | K site | sample 1 | sample 2 | sample 3 | sample 4 |
|---|---|---|---|---|---|---|---|---|---|---|---|---|---|---|---|---|---|---|---|---|---|---|---|
| 1 | K 7 | | | | | 51 | K 879 | | | | | 101 | K 2033 | | | | | 151 | K 3044 | | | | |
| 2 | K 26 | | | | | 52 | K 884 | | | | | 102 | K 2066 | | | | | 152 | K 3048 | | | | |
| 3 | K 53 | | | | | 53 | K 918 | | | | | 103 | K 2067 | | | | | 153 | K 3052 | | | | |
| 4 | K 67 | | | | | 54 | K 924 | | | | | 104 | K 2076 | | | | | 154 | K 3077 | | | | |
| 5 | K 84 | | | | | 55 | K 929 | | | | | 105 | K 2099 | | | | | 155 | K 3079 | | | | |
| 6 | K 88 | | | | | 56 | K 946 | | | | | 106 | K 2102 | | | | | 156 | K 3092 | | | | |
| 7 | K 96 | | | | | 57 | K 952 | | | | | 107 | K 2104 | | | | | total | | 13 | 7 | 6 | 9 |
| 8 | K 123 | | | | | 58 | K 956 | O | O | | O | 108 | K 2131 | | | | | | | | | | |
| 9 | K 131 | | | | | 59 | K 986 | | | | | 109 | K 2149 | | | | | | | | | | |
| 10 | K 142 | | | | | 60 | K 1017 | | | | | 110 | K 2160 | | | | | | | | | | |
| 11 | K 161 | O | | O | | 61 | K 1059 | | | | | 111 | K 2187 | | | | | | | | | | |
| 12 | K 190 | | | | | 62 | K 1060 | | | | | 112 | K 2233 | | | | | | | | | | |
| 13 | K 251 | | | | | 63 | K 1073 | | | | | 113 | K 2247 | O | O | O | O | | | | | | |
| 14 | K 280 | | | | | 64 | K 1104 | O | O | O | O | 114 | K 2281 | | | | | | | | | | |
| 15 | K 289 | | | | | 65 | K 1117 | | | | | 115 | K 2302 | | | | | | | | | | |
| 16 | K 373 | | | | | 66 | K 1160 | | | | | 116 | K 2360 | O | O | | | | | | | | |
| 17 | K 389 | | | | | 67 | K 1162 | | | | | 117 | K 2460 | | | | | | | | | | |
| 18 | K 402 | | | O | | 68 | K 1199 | | | | | 118 | K 2481 | | | | | | | | | | |
| 19 | K 411 | | | | | 69 | K 1221 | | | | | 119 | K 2506 | | | | | | | | | | |
| 20 | K 438 | | | | | 70 | K 1230 | | | | | 120 | K 2507 | | | | | | | | | | |
| 21 | K 469 | | | | | 71 | K 1270 | | | | | 121 | K 2514 | | | | | | | | | | |
| 22 | K 477 | | | | | 72 | K 1303 | | | | | 122 | K 2516 | | | | | | | | | | |
| 23 | K 488 | | | | | 73 | K 1330 | | | | | 123 | K 2531 | | | | | | | | | | |
| 24 | K 491 | | | | | 74 | K 1335 | | | | | 124 | K 2532 | | | | | | | | | | |
| 25 | K 499 | | | | | 75 | K 1338 | | | | | 125 | K 2579 | | | | | | | | | | |
| 26 | K 507 | | | | | 76 | K 1339 | | | | | 126 | K 2601 | | | | | | | | | | |
| 27 | K 530 | | | | | 77 | K 1395 | | | | | 127 | K 2609 | | | | | | | | | | |
| 28 | K 549 | | | | | 78 | K 1402 | | | | | 128 | K 2620 | | | | | | | | | | |
| 29 | K 554 | | | | | 79 | K 1410 | | | | | 129 | K 2624 | | | | | | | | | | |
| 30 | K 557 | | | | | 80 | K 1416 | | | | | 130 | K 2637 | | | | | | | | | | |
| 31 | K 566 | | | | | 81 | K 1444 | O | O | | | 131 | K 2656 | | | | | | | | | | |
| 32 | K 581 | | | | | 82 | K 1473 | O | | | | 132 | K 2682 | | | | | | | | | | |
| 33 | K 587 | | | | | 83 | K 1518 | | | | | 133 | K 2686 | | | | | | | | | | |
| 34 | K 590 | O | | | | 84 | K 1529 | | | | | 134 | K 2713 | | | | | | | | | | |
| 35 | K 606 | | | | O | 85 | K 1543 | | | | | 135 | K 2714 | | | | | | | | | | |
| 36 | K 615 | | | | | 86 | K 1583 | | | | O | 136 | K 2748 | | | | | | | | | | |
| 37 | K 616 | | | | | 87 | K 1636 | | | | | 137 | K 2771 | | | | | | | | | | |
| 38 | K 671 | | | | | 88 | K 1640 | | | | | 138 | K 2814 | | | | | | | | | | |
| 39 | K 681 | | | | | 89 | K 1659 | | O | | O | 139 | K 2838 | | | | | | | | | | |
| 40 | K 695 | | | | | 90 | K 1668 | | | | | 140 | K 2848 | | | | | | | | | | |
| 41 | K 704 | | | | | 91 | K 1738 | | | | | 141 | K 2852 | O | O | O | O | | | | | | |
| 42 | K 719 | O | | O | | 92 | K 1749 | | | | | 142 | K 2900 | O | | | | | | | | | |
| 43 | K 787 | | | | O | 93 | K 1798 | | | | | 143 | K 2934 | | | | | | | | | | |
| 44 | K 791 | | | | | 94 | K 1809 | | | | | 144 | K 2943 | | | | | | | | | | |
| 45 | K 823 | | | | | 95 | K 1826 | | | | | 145 | K 2947 | | | | | | | | | | |
| 46 | K 835 | | | | | 96 | K 1853 | | | | | 146 | K 2967 | | | | | | | | | | |
| 47 | K 857 | | | | | 97 | K 1903 | | | | | 147 | K 2996 | | | | | | | | | | |
| 48 | K 858 | | | | | 98 | K 1915 | | | | | 148 | K 3002 | | | | | | | | | | |
| 49 | K 863 | | | | | 99 | K 1924 | O | | | O | 149 | K 3003 | O | | | | | | | | | |
| 50 | K 878 | | | | | 100 | K 2022 | | | | | 150 | K 3037 | | | | | | | | | | |

Figure 30 continued

| # | K site | sample 1 | sample 2 | sample 3 | sample 4 | # | K site | sample 1 | sample 2 | sample 3 | sample 4 | # | K site | sample 1 | sample 2 | sample 3 | sample 4 |
|---|---|---|---|---|---|---|---|---|---|---|---|---|---|---|---|---|---|
| 1 | K 26 | O | O |  |  | 51 | K 1127 |  |  |  |  | 101 | K 2198 |  |  |  |  |
| 2 | K 41 |  |  |  |  | 52 | K 1155 |  |  |  |  | 102 | K 2202 |  |  |  |  |
| 3 | K 71 |  |  |  |  | 53 | K 1176 |  |  |  |  | 103 | K 2227 |  |  |  |  |
| 4 | K 74 |  |  |  |  | 54 | K 1181 |  |  |  |  | 104 | K 2231 |  |  |  |  |
| 5 | K 104 |  |  |  |  | 55 | K 1212 |  |  |  |  | 105 | K 2317 |  |  |  |  |
| 6 | K 105 |  |  |  |  | 56 | K 1233 |  |  | O | O | 106 | K 2327 |  |  |  |  |
| 7 | K 138 |  |  |  |  | 57 | K 1280 |  |  |  |  | 107 | K 2328 |  |  |  |  |
| 8 | K 154 |  |  |  |  | 58 | K 1302 | O | O |  |  | 108 | K 3330 |  |  |  |  |
| 9 | K 155 |  |  |  |  | 59 | K 1311 |  |  |  |  | 109 | K 2335 |  |  |  |  |
| 10 | K 167 | O | O |  | O | 60 | K 1315 |  |  |  |  | 110 | K 2345 |  |  |  |  |
| 11 | K 191 |  |  |  |  | 61 | K 1368 |  | O | O |  | 111 | K 2361 |  |  |  |  |
| 12 | K 250 |  | O |  |  | 62 | K 1418 |  |  |  |  | 112 | K 2400 |  |  |  |  |
| 13 | K 284 | O | O |  | O | 63 | K 1456 | O |  |  |  | 113 | K 2426 |  |  |  |  |
| 14 | K 321 |  |  |  |  | 64 | K 1493 |  |  |  |  | 114 | K 2444 |  |  |  |  |
| 15 | K 358 |  |  |  |  | 65 | K 1494 |  |  |  |  | 115 | K 2455 |  |  |  |  |
| 16 | K 372 |  |  |  |  | 66 | K 1508 |  |  |  |  | 116 | K 2463 | O | O |  | O |
| 17 | K 401 |  |  |  |  | 67 | K 1526 | O | O | O |  | 117 | K 2482 |  |  |  |  |
| 18 | K 428 |  |  |  |  | 68 | K 1556 | O |  |  |  | 118 | K 2490 |  |  |  |  |
| 19 | K 433 | O | O | O |  | 69 | K 1565 |  |  |  |  | 119 | K 2527 | O | O |  |  |
| 20 | K 447 |  |  |  |  | 70 | K 1600 |  |  |  |  | 120 | K 2596 |  |  |  |  |
| 21 | K 462 |  |  |  |  | 71 | K 1602 |  |  |  |  | 121 | K 2737 |  |  |  | O |
| 22 | K 471 | O | O |  | O | 72 | K 1624 |  |  |  |  | 122 | K 2754 |  |  |  |  |
| 23 | K 495 |  |  |  |  | 73 | K 1633 |  |  |  |  | 123 | K 2758 |  |  |  |  |
| 24 | K 562 |  |  |  |  | 74 | K 1646 |  |  |  |  | 124 | K 2810 |  |  |  |  |
| 25 | K 585 |  |  |  |  | 75 | K 1675 |  |  |  |  | 125 | K 2811 |  |  |  |  |
| 26 | K 589 |  |  |  |  | 76 | K 1690 |  |  |  |  | 126 | K 2870 |  |  |  |  |
| 27 | K 634 |  |  |  |  | 77 | K 1700 |  |  |  |  | 127 | K 2873 |  |  |  |  |
| 28 | K 672 |  |  |  |  | 78 | K 1705 |  |  |  |  | 128 | K 2888 |  |  |  |  |
| 29 | K 675 |  |  |  |  | 79 | K 1708 |  |  |  |  | 129 | K 2903 |  |  |  |  |
| 30 | K 688 |  |  |  |  | 80 | K 1767 |  |  |  |  | 130 | K 2934 |  |  |  |  |
| 31 | K 701 |  |  |  |  | 81 | K 1787 |  |  |  |  | 131 | K 2948 |  |  |  |  |
| 32 | K 741 |  |  |  |  | 82 | K 1803 |  |  |  |  | 132 | K 2953 |  |  |  |  |
| 33 | K 774 |  |  |  |  | 83 | K 1811 |  |  |  |  | 133 | K 3010 |  |  |  |  |
| 34 | K 776 |  |  |  |  | 84 | K 1835 |  |  |  |  | 134 | K 3025 | O |  |  |  |
| 35 | K 787 |  |  |  |  | 85 | K 1879 |  |  |  |  | 135 | K 3045 |  |  |  |  |
| 36 | K 790 |  |  |  |  | 86 | K 1921 |  |  |  |  | 136 | K 3050 |  |  |  |  |
| 37 | K 798 |  |  |  |  | 87 | K 1931 |  |  |  |  | 137 | K 3145 |  |  |  |  |
| 38 | K 806 |  |  |  |  | 88 | K 1935 |  |  |  |  | 138 | K 3148 |  |  |  |  |
| 39 | K 848 |  |  |  |  | 89 | K 1947 |  |  |  |  | 139 | K 3149 |  |  |  |  |
| 40 | K 855 |  |  |  |  | 90 | K 1954 | O | O |  | O | 140 | K 3155 |  |  |  |  |
| 41 | K 858 |  |  |  |  | 91 | K 1986 |  | O |  | O | 141 | K 3184 |  |  |  |  |
| 42 | K 882 |  |  |  |  | 92 | K 2001 |  |  |  |  | 142 | K 3193 |  |  |  |  |
| 43 | K 898 |  |  | O |  | 93 | K 2044 |  |  |  |  | 143 | K 3240 |  |  |  |  |
| 44 | K 907 |  |  |  |  | 94 | K 2049 |  |  |  |  | 144 | K 3263 |  |  |  |  |
| 45 | K 908 |  |  |  |  | 95 | K 2052 |  |  |  |  | 145 | K 3274 |  |  |  |  |
| 46 | K 936 | O |  |  |  | 96 | K 2055 |  |  |  |  | 146 | K 3321 |  |  |  |  |
| 47 | K 1011 |  |  |  |  | 97 | K 2065 |  |  |  |  | 147 | K 3336 |  |  |  |  |
| 48 | K 1079 |  |  |  |  | 98 | K 2069 |  |  |  |  | 148 | K 3340 |  |  |  |  |
| 49 | K 1083 |  |  |  |  | 99 | K 2092 |  |  |  |  | 149 | K 3344 |  |  |  |  |
| 50 | K 1097 | O | O | O | O | 100 | K 2121 |  |  |  |  | 150 | K 3404 |  |  |  |  |
|  |  |  |  |  |  |  |  |  |  |  |  |  | total | 15 | 14 | 5 | 10 |

Figure 30 continued

| # | K site | sample 1 | 2 | 3 | 4 | # | K site | sample 1 | 2 | 3 | 4 | # | K site | sample 1 | 2 | 3 | 4 | # | K site | sample 1 | 2 | 3 | 4 |
|---|---|---|---|---|---|---|---|---|---|---|---|---|---|---|---|---|---|---|---|---|---|---|---|
| 1 | K 7 | O | O | O | O | 51 | K 879 |   |   |   |   | 101 | K 2033 |   |   |   |   | 151 | K 3044 |   |   |   |   |
| 2 | K 26 |   |   |   |   | 52 | K 884 |   |   |   |   | 102 | K 2066 |   |   |   |   | 152 | K 3048 |   |   |   |   |
| 3 | K 53 | O | O | O | O | 53 | K 918 |   |   |   |   | 103 | K 2067 | O | O | O | O | 153 | K 3052 |   |   |   |   |
| 4 | K 67 | O | O | O | O | 54 | K 974 |   |   |   |   | 104 | K 2076 | O | O | O | O | 154 | K 3077 |   |   |   |   |
| 5 | K 84 | O | O | O | O | 55 | K 929 |   |   |   |   | 105 | K 2099 | O | O | O | O | 155 | K 3079 |   | O |   |   |
| 6 | K 88 |   |   |   |   | 56 | K 946 | O | O | O |   | 106 | K 2102 |   | O |   | O | 156 | K 3092 | O | O | O | O |
| 7 | K 96 | O |   | O | O | 57 | K 952 |   |   |   |   | 107 | K 2104 |   | O |   | O |   | total | 86 | 83 | 86 | 84 |
| 8 | K 123 | O | O | O | O | 58 | K 956 | O | O | O | O | 108 | K 2131 | O | O | O | O |   |   |   |   |   |   |
| 9 | K 131 | O | O | O | O | 59 | K 986 | O | O | O | O | 109 | K 2149 |   |   |   |   |   |   |   |   |   |   |
| 10 | K 142 |   | O | O | O | 60 | K 1017 | O | O | O |   | 110 | K 2160 | O | O | O |   |   |   |   |   |   |   |
| 11 | K 161 | O | O | O | O | 61 | K 1059 | O | O |   | O | 111 | K 2187 |   |   |   |   |   |   |   |   |   |   |
| 12 | K 190 |   | O | O | O | 62 | K 1060 | O | O | O | O | 112 | K 2233 |   |   |   |   |   |   |   |   |   |   |
| 13 | K 251 |   |   |   |   | 63 | K 1073 | O |   | O | O | 113 | K 2247 | O | O | O | O |   |   |   |   |   |   |
| 14 | K 280 |   |   |   |   | 64 | K 1104 | O | O | O | O | 114 | K 2281 |   |   |   |   |   |   |   |   |   |   |
| 15 | K 289 |   |   |   |   | 65 | K 1117 |   | O |   | O | 115 | K 2302 | O |   |   |   |   |   |   |   |   |   |
| 16 | K 373 |   |   |   |   | 66 | K 1160 |   |   |   |   | 116 | K 2360 | O | O | O | O |   |   |   |   |   |   |
| 17 | K 389 | O |   | O |   | 67 | K 1162 | O | O | O |   | 117 | K 2460 |   |   |   |   |   |   |   |   |   |   |
| 18 | K 402 |   |   |   |   | 68 | K 1199 | O | O | O | O | 118 | K 2481 | O | O | O | O |   |   |   |   |   |   |
| 19 | K 411 |   |   |   |   | 69 | K 1221 |   | O |   | O | 119 | K 2506 |   |   |   |   |   |   |   |   |   |   |
| 20 | K 438 | O | O | O | O | 70 | K 1230 | O | O | O | O | 120 | K 2507 | O | O | O | O |   |   |   |   |   |   |
| 21 | K 469 | O |   | O | O | 71 | K 1270 |   |   |   |   | 121 | K 2514 | O | O | O | O |   |   |   |   |   |   |
| 22 | K 477 | O |   | O | O | 72 | K 1303 |   |   |   |   | 122 | K 2516 | O | O | O | O |   |   |   |   |   |   |
| 23 | K 488 |   |   |   |   | 73 | K 1330 |   |   |   |   | 123 | K 2531 |   |   |   |   |   |   |   |   |   |   |
| 24 | K 491 | O |   |   |   | 74 | K 1335 | O | O | O | O | 124 | K 2532 |   |   |   |   |   |   |   |   |   |   |
| 25 | K 499 |   |   |   |   | 75 | K 1338 |   |   |   |   | 125 | K 2579 |   |   |   |   |   |   |   |   |   |   |
| 26 | K 507 |   |   |   |   | 76 | K 1339 |   |   |   |   | 126 | K 2601 | O | O | O | O |   |   |   |   |   |   |
| 27 | K 530 | O | O | O | O | 77 | K 1395 | O | O | O | O | 127 | K 2609 | O | O | O | O |   |   |   |   |   |   |
| 28 | K 549 |   |   |   |   | 78 | K 1402 | O | O | O | O | 128 | K 2620 |   |   |   |   |   |   |   |   |   |   |
| 29 | K 554 | O | O | O | O | 79 | K 1410 | O | O | O | O | 129 | K 2624 | O | O | O | O |   |   |   |   |   |   |
| 30 | K 557 |   |   |   | O | 80 | K 1416 |   |   |   |   | 130 | K 2637 | O | O | O | O |   |   |   |   |   |   |
| 31 | K 566 | O | O | O | O | 81 | K 1444 | O |   | O |   | 131 | K 2656 | O | O | O | O |   |   |   |   |   |   |
| 32 | K 581 | O | O | O | O | 82 | K 1473 | O | O | O | O | 132 | K 2682 |   |   | O |   |   |   |   |   |   |   |
| 33 | K 587 |   |   |   |   | 83 | K 1518 | O | O | O | O | 133 | K 2686 |   |   | O | O |   |   |   |   |   |   |
| 34 | K 590 | O | O | O | O | 84 | K 1529 | O |   |   |   | 134 | K 2713 |   |   |   |   |   |   |   |   |   |   |
| 35 | K 606 | O | O | O | O | 85 | K 1543 |   |   |   |   | 135 | K 2714 |   |   | O | O |   |   |   |   |   |   |
| 36 | K 615 |   |   |   |   | 86 | K 1583 | O | O | O | O | 136 | K 2748 | O | O | O | O |   |   |   |   |   |   |
| 37 | K 616 |   |   |   |   | 87 | K 1636 |   |   |   |   | 137 | K 2771 | O | O | O | O |   |   |   |   |   |   |
| 38 | K 671 | O | O | O | O | 88 | K 1640 |   |   |   |   | 138 | K 2814 | O | O | O | O |   |   |   |   |   |   |
| 39 | K 681 | O |   |   |   | 89 | K 1659 | O | O | O | O | 139 | K 2838 |   |   |   |   |   |   |   |   |   |   |
| 40 | K 695 | O | O | O | O | 90 | K 1668 | O | O | O | O | 140 | K 2848 |   |   |   |   |   |   |   |   |   |   |
| 41 | K 704 | O | O | O | O | 91 | K 1738 | O | O | O | O | 141 | K 2852 | O | O | O | O |   |   |   |   |   |   |
| 42 | K 719 | O | O | O | O | 92 | K 1749 | O | O |   | O | 142 | K 2900 | O | O | O | O |   |   |   |   |   |   |
| 43 | K 787 | O | O | O | O | 93 | K 1758 | O | O | O | O | 143 | K 2924 |   |   |   |   |   |   |   |   |   |   |
| 44 | K 791 | O | O | O | O | 94 | K 1809 |   |   |   |   | 144 | K 2943 | O |   | O | O |   |   |   |   |   |   |
| 45 | K 823 | O | O | O |   | 95 | K 1826 | O | O | O | O | 145 | K 2947 | O | O | O | O |   |   |   |   |   |   |
| 46 | K 835 | O | O | O | O | 96 | K 1853 |   |   |   |   | 146 | K 2967 | O | O | O | O |   |   |   |   |   |   |
| 47 | K 857 |   |   |   |   | 97 | K 1903 | O | O | O | O | 147 | K 2996 | O | O | O | O |   |   |   |   |   |   |
| 48 | K 858 | O | O | O | O | 98 | K 1915 |   |   | O | O | 148 | K 3002 |   | O |   |   |   |   |   |   |   |   |
| 49 | K 863 |   | O |   | O | 99 | K 1924 | O | O | O | O | 149 | K 3003 | O | O | O | O |   |   |   |   |   |   |
| 50 | K 878 |   |   |   |   | 100 | K 2022 |   |   |   |   | 150 | K 3037 | O |   | O |   |   |   |   |   |   |   |

Figure 31

| # | K site | sample 1 | 2 | 3 | 4 | # | K site | sample 1 | 2 | 3 | 4 | # | K site | sample 1 | 2 | 3 | 4 |
|---|---|---|---|---|---|---|---|---|---|---|---|---|---|---|---|---|---|
| 1 | K 26 | O | O | O | O | 51 | K 1127 | O | O | O | O | 101 | K 2198 | O | O | O | O |
| 2 | K 41 | O | | O | | 52 | K 1155 | | | | | 102 | K 2202 | O | O | O | O |
| 3 | K 71 | | | | | 53 | K 1176 | | | O | | 103 | K 2227 | O | O | O | O |
| 4 | K 74 | O | | O | | 54 | K 1181 | | | | | 104 | K 2231 | O | O | O | O |
| 5 | K 104 | | | | | 55 | K 1212 | | O | | O | 105 | K 2317 | | | | |
| 6 | K 105 | | | | | 56 | K 1233 | O | O | O | O | 106 | K 2327 | | | | |
| 7 | K 138 | | | | | 57 | K 1280 | | | | | 107 | K 2328 | | | | |
| 8 | K 154 | O | O | | | 58 | K 1302 | O | O | O | O | 108 | K 3330 | | | | |
| 9 | K 155 | O | O | O | O | 59 | K 1311 | O | O | O | O | 109 | K 2335 | | | | |
| 10 | K 167 | O | O | O | O | 60 | K 1315 | O | O | O | O | 110 | K 2345 | | | | |
| 11 | K 191 | O | O | O | O | 61 | K 1368 | O | O | O | O | 111 | K 2361 | O | O | O | O |
| 12 | K 250 | O | O | O | O | 62 | K 1418 | O | O | O | O | 112 | K 2400 | | | | O |
| 13 | K 284 | O | O | O | O | 63 | K 1456 | O | O | O | O | 113 | K 2426 | | O | | |
| 14 | K 321 | O | | | O | 64 | K 1493 | O | | | | 114 | K 2444 | | | | |
| 15 | K 358 | | | | | 65 | K 1494 | O | O | O | O | 115 | K 2455 | O | O | | O |
| 16 | K 372 | O | O | O | O | 66 | K 1508 | O | | | | 116 | K 2463 | O | O | O | O |
| 17 | K 401 | | | | | 67 | K 1526 | O | O | O | O | 117 | K 2482 | O | O | O | |
| 18 | K 428 | O | O | O | O | 68 | K 1556 | O | O | O | O | 118 | K 2490 | | | | |
| 19 | K 433 | O | O | O | O | 69 | K 1565 | | | | | 119 | K 2527 | O | O | O | O |
| 20 | K 447 | | | | | 70 | K 1600 | O | O | O | O | 120 | K 2596 | | | | |
| 21 | K 462 | | | | | 71 | K 1602 | O | O | O | O | 121 | K 2737 | O | O | | |
| 22 | K 471 | O | O | O | O | 72 | K 1624 | O | | | O | 122 | K 2754 | O | O | O | |
| 23 | K 495 | | O | O | O | 73 | K 1633 | | | | | 123 | K 2758 | O | O | O | O |
| 24 | K 562 | | | O | | 74 | K 1646 | O | | | | 124 | K 2810 | | | | O |
| 25 | K 585 | | | | | 75 | K 1675 | | | | | 125 | K 2811 | | | | O |
| 26 | K 589 | | | | | 76 | K 1690 | O | | | | 126 | K 2870 | O | O | O | O |
| 27 | K 634 | O | O | O | O | 77 | K 1700 | O | O | O | O | 127 | K 2873 | | | | |
| 28 | K 672 | | | | | 78 | K 1705 | | | | | 128 | K 2888 | | | | |
| 29 | K 675 | | | | | 79 | K 1708 | O | O | O | | 129 | K 2903 | | | | |
| 30 | K 688 | | | | | 80 | K 1767 | O | O | O | O | 130 | K 2934 | | | | |
| 31 | K 701 | | | | | 81 | K 1782 | O | | | | 131 | K 2948 | O | O | O | O |
| 32 | K 741 | | | | | 82 | K 1803 | O | O | O | O | 132 | K 2953 | | | | |
| 33 | K 774 | | | | | 83 | K 1811 | O | O | | | 133 | K 3010 | O | O | O | O |
| 34 | K 776 | | | | | 84 | K 1835 | | | | | 134 | K 3025 | | O | O | |
| 35 | K 787 | | | | | 85 | K 1879 | | | | | 135 | K 3045 | | | | |
| 36 | K 790 | O | | | | 86 | K 1921 | | | | | 136 | K 3050 | | | | |
| 37 | K 798 | | | | | 87 | K 1931 | | | | | 137 | K 3145 | | | | |
| 38 | K 806 | | | | | 88 | K 1935 | | | | | 138 | K 3148 | | | | |
| 39 | K 848 | | | | | 89 | K 1947 | | | | | 139 | K 3149 | O | O | O | O |
| 40 | K 855 | | | | | 90 | K 1954 | O | O | O | O | 140 | K 3155 | | | | |
| 41 | K 858 | | | | | 91 | K 1986 | O | O | O | O | 141 | K 3184 | | | | |
| 42 | K 882 | | | | | 92 | K 2001 | O | O | O | | 142 | K 3193 | | | | |
| 43 | K 898 | O | O | O | O | 93 | K 2044 | | | | | 143 | K 3240 | O | O | O | O |
| 44 | K 907 | | | | | 94 | K 2049 | O | | | | 144 | K 3263 | | | | |
| 45 | K 908 | | | | | 95 | K 2052 | | | O | | 145 | K 3274 | | | | |
| 46 | K 936 | O | O | O | O | 96 | K 2055 | | | | | 146 | K 3321 | | | | |
| 47 | K 1011 | O | | O | | 97 | K 2065 | | | O | | 147 | K 3336 | | | | |
| 48 | K 1079 | O | O | O | O | 98 | K 2069 | | | | | 148 | K 3340 | | | | |
| 49 | K 1083 | O | O | O | O | 99 | K 2092 | | | | | 149 | K 3344 | | | | |
| 50 | K 1097 | O | O | O | O | 100 | K 2121 | O | | | | 150 | K 3404 | O | O | O | O |
| | | | | | | | | | | | | | total | 69 | 60 | 61 | 56 |

Figure 31 continued

| # | K site | sample 1 | 2 | 3 | 4 | # | K site | sample 1 | 2 | 3 | 4 | # | K site | sample 1 | 2 | 3 | 4 | # | K site | sample 1 | 2 | 3 | 4 |
|---|---|---|---|---|---|---|---|---|---|---|---|---|---|---|---|---|---|---|---|---|---|---|---|
| 1 | K 7 | O | O | O | O | 51 | K 879 | | | O | O | 101 | K 2033 | | | | | 151 | K 3044 | | | | |
| 2 | K 26 | | | | | 52 | K 884 | | | | | 102 | K 2066 | | | | | 152 | K 3048 | | | | |
| 3 | K 53 | O | O | O | O | 53 | K 918 | | O | | | 103 | K 2067 | O | O | O | O | 153 | K 3052 | | | | |
| 4 | K 67 | O | O | O | O | 54 | K 924 | | O | O | | 104 | K 2076 | | | O | | 154 | K 3077 | | | O | |
| 5 | K 84 | O | O | O | O | 55 | K 929 | | | | | 105 | K 2099 | O | O | O | O | 155 | K 3079 | O | | | |
| 6 | K 88 | | | | | 56 | K 946 | O | | O | O | 106 | K 2102 | | O | O | O | 156 | K 3092 | O | O | | O |
| 7 | K 96 | O | O | O | | 57 | K 952 | | | | | 107 | K 2104 | | O | O | O | | total | 80 | 81 | 86 | 78 |
| 8 | K 123 | O | O | O | O | 58 | K 956 | O | O | O | O | 108 | K 2131 | O | O | O | O | | | | | | |
| 9 | K 131 | O | O | O | O | 59 | K 986 | O | O | O | O | 109 | K 2149 | | | | | | | | | | |
| 10 | K 142 | O | O | O | O | 60 | K 1017 | | | O | | 110 | K 2160 | O | | | | | | | | | |
| 11 | K 161 | O | O | O | O | 61 | K 1059 | O | O | | | 111 | K 2187 | | | | | | | | | | |
| 12 | K 190 | | O | | O | 62 | K 1060 | O | O | O | O | 112 | K 2233 | | | | | | | | | | |
| 13 | K 251 | | | | | 63 | K 1073 | O | | | | 113 | K 2247 | O | O | O | O | | | | | | |
| 14 | K 280 | O | | O | | 64 | K 1104 | O | O | O | O | 114 | K 2281 | | | | | | | | | | |
| 15 | K 289 | | | | | 65 | K 1117 | O | | O | | 115 | K 2302 | O | O | | O | | | | | | |
| 16 | K 373 | | | | | 66 | K 1160 | | | | | 116 | K 2360 | O | O | O | O | | | | | | |
| 17 | K 389 | | | | | 67 | K 1162 | O | O | O | | 117 | K 2460 | | | | | | | | | | |
| 18 | K 402 | | | | | 68 | K 1199 | O | O | O | O | 118 | K 2481 | O | O | O | O | | | | | | |
| 19 | K 411 | | | | | 69 | K 1221 | | O | | O | 119 | K 2506 | | | | | | | | | | |
| 20 | K 438 | O | O | O | O | 70 | K 1230 | O | O | O | O | 120 | K 2507 | O | O | O | O | | | | | | |
| 21 | K 469 | O | | O | | 71 | K 1270 | | | | | 121 | K 2514 | O | O | O | O | | | | | | |
| 22 | K 477 | O | | O | | 72 | K 1303 | | | | | 122 | K 2516 | O | O | O | O | | | | | | |
| 23 | K 488 | | | | | 73 | K 1330 | | | | | 123 | K 2531 | | | | | | | | | | |
| 24 | K 491 | | | | | 74 | K 1335 | O | O | O | O | 124 | K 2532 | | | | | | | | | | |
| 25 | K 499 | | | | | 75 | K 1338 | | | | | 125 | K 2579 | | | | | | | | | | |
| 26 | K 507 | | | | | 76 | K 1339 | | | | | 126 | K 2601 | O | O | O | O | | | | | | |
| 27 | K 530 | O | O | O | O | 77 | K 1395 | O | O | O | O | 127 | K 2609 | O | O | O | O | | | | | | |
| 28 | K 549 | | | | | 78 | K 1402 | | O | O | O | 128 | K 2620 | | | | | | | | | | |
| 29 | K 554 | O | O | O | O | 79 | K 1410 | O | O | O | O | 129 | K 2624 | O | O | O | O | | | | | | |
| 30 | K 557 | | | O | | 80 | K 1416 | | | | | 130 | K 2637 | O | O | O | O | | | | | | |
| 31 | K 566 | O | O | O | O | 81 | K 1444 | | O | O | O | 131 | K 2656 | O | O | O | O | | | | | | |
| 32 | K 581 | O | O | O | O | 82 | K 1473 | O | O | O | O | 132 | K 2682 | | | | | | | | | | |
| 33 | K 587 | | | | | 83 | K 1518 | O | O | O | O | 133 | K 2686 | O | | O | | | | | | | |
| 34 | K 590 | O | O | | O | 84 | K 1529 | | | | O | 134 | K 2713 | | | | | | | | | | |
| 35 | K 606 | O | O | O | O | 85 | K 1543 | | | | | 135 | K 2714 | | | O | | | | | | | |
| 36 | K 615 | | | | | 86 | K 1583 | O | O | O | O | 136 | K 2748 | O | O | | | | | | | | |
| 37 | K 616 | | | | | 87 | K 1636 | | | | | 137 | K 2771 | O | O | O | O | | | | | | |
| 38 | K 671 | O | O | O | O | 88 | K 1640 | | | | | 138 | K 2814 | O | O | O | O | | | | | | |
| 39 | K 681 | | O | | | 89 | K 1659 | O | O | O | O | 139 | K 2838 | | | | | | | | | | |
| 40 | K 695 | O | O | O | O | 90 | K 1668 | O | O | O | O | 140 | K 2848 | | | | | | | | | | |
| 41 | K 704 | O | O | O | O | 91 | K 1738 | O | O | O | O | 141 | K 2852 | O | O | O | O | | | | | | |
| 42 | K 719 | O | O | O | O | 92 | K 1749 | | O | | O | 142 | K 2900 | O | O | O | O | | | | | | |
| 43 | K 787 | O | O | O | O | 93 | K 1758 | O | O | O | O | 143 | K 2924 | | | | | | | | | | |
| 44 | K 791 | O | O | O | O | 94 | K 1809 | | | | | 144 | K 2943 | | O | O | | | | | | | |
| 45 | K 823 | | | O | | 95 | K 1826 | O | O | O | O | 145 | K 2947 | O | O | O | O | | | | | | |
| 46 | K 835 | O | O | O | O | 96 | K 1853 | | | | | 146 | K 2967 | O | O | O | O | | | | | | |
| 47 | K 857 | | | | | 97 | K 1903 | O | O | O | O | 147 | K 2996 | O | O | O | O | | | | | | |
| 48 | K 858 | O | O | O | O | 98 | K 1915 | | | O | | 148 | K 3002 | | | | | | | | | | |
| 49 | K 863 | | | | O | 99 | K 1924 | O | O | O | O | 149 | K 3003 | O | O | O | O | | | | | | |
| 50 | K 878 | | | | | 100 | K 2022 | | | | | 150 | K 3037 | | | O | | | | | | | |

Figure 31 continued

| # | K site | sample | | | | # | K site | sample | | | | # | K site | sample | | | |
|---|---|---|---|---|---|---|---|---|---|---|---|---|---|---|---|---|---|
| | | 1 | 2 | 3 | 4 | | | 1 | 2 | 3 | 4 | | | 1 | 2 | 3 | 4 |
| 1 | K 26 | O | O | O | O | 51 | K 1127 | O | O | O | O | 101 | K 2198 | O | O | O | O |
| 2 | K 41 | | | | O | 52 | K 1155 | | | | | 102 | K 2202 | O | O | O | O |
| 3 | K 71 | | | | | 53 | K 1176 | | | O | | 103 | K 2227 | O | O | O | O |
| 4 | K 74 | | | | O | 54 | K 1181 | | | | | 104 | K 2231 | O | O | O | O |
| 5 | K 104 | | | | | 55 | K 1212 | | O | | | 105 | K 2317 | | | | |
| 6 | K 105 | | | | | 56 | K 1233 | O | O | O | O | 106 | K 2327 | | | | |
| 7 | K 138 | | | | | 57 | K 1280 | | | | | 107 | K 2328 | | | | |
| 8 | K 154 | | | | | 58 | K 1302 | O | O | O | O | 108 | K 3330 | | | | |
| 9 | K 155 | O | O | O | O | 59 | K 1311 | O | | | O | 109 | K 2335 | | | | |
| 10 | K 167 | O | O | O | O | 60 | K 1315 | O | O | O | O | 110 | K 2345 | | | | |
| 11 | K 193 | O | O | O | O | 61 | K 1368 | O | O | O | O | 111 | K 2361 | | O | | O |
| 12 | K 250 | O | O | O | O | 62 | K 1418 | O | O | O | O | 112 | K 2400 | | | | O |
| 13 | K 284 | O | O | O | O | 63 | K 1456 | O | O | O | O | 113 | K 2426 | | | | |
| 14 | K 321 | | | O | O | 64 | K 1493 | O | | | | 114 | K 2444 | | | | |
| 15 | K 358 | | | | | 65 | K 1494 | O | O | O | O | 115 | K 2455 | O | O | | O |
| 16 | K 372 | O | O | O | O | 66 | K 1508 | O | | | | 116 | K 2463 | O | O | O | O |
| 17 | K 401 | | | | | 67 | K 1526 | O | O | O | O | 117 | K 2482 | O | O | O | O |
| 18 | K 428 | O | | O | O | 68 | K 1556 | O | O | O | O | 118 | K 2490 | | | | |
| 19 | K 433 | O | O | O | O | 69 | K 1565 | | | | | 119 | K 2527 | O | O | O | O |
| 20 | K 447 | | | | | 70 | K 1600 | O | O | O | O | 120 | K 2596 | | | | |
| 21 | K 462 | O | | | | 71 | K 1602 | O | O | O | O | 121 | K 2737 | O | O | | O |
| 22 | K 471 | O | O | O | O | 72 | K 1624 | | | | O | 122 | K 2754 | O | | O | |
| 23 | K 495 | | O | | O | 73 | K 1633 | | | O | | 123 | K 2758 | O | O | O | O |
| 24 | K 562 | O | | | | 74 | K 1646 | | | | | 124 | K 2810 | | | | |
| 25 | K 585 | | | | | 75 | K 1675 | | | | | 125 | K 2811 | O | | | |
| 26 | K 589 | | | | | 76 | K 1690 | | | | | 126 | K 2870 | O | O | | O |
| 27 | K 634 | O | O | O | O | 77 | K 1700 | O | O | O | O | 127 | K 2873 | | | | |
| 28 | K 672 | | | | | 78 | K 1705 | | | | | 128 | K 2888 | | | | |
| 29 | K 675 | | | | | 79 | K 1708 | O | O | O | | 129 | K 2903 | | | | |
| 30 | K 688 | | | | | 80 | K 1767 | O | O | O | | 130 | K 2934 | | | | |
| 31 | K 701 | | | | | 81 | K 1782 | | O | | O | 131 | K 2948 | O | O | O | O |
| 32 | K 741 | | | | | 82 | K 1803 | O | O | O | O | 132 | K 2953 | | | | |
| 33 | K 774 | | | | | 83 | K 1811 | | O | | | 133 | K 3010 | O | O | O | O |
| 34 | K 776 | | | | | 84 | K 1835 | | | | | 134 | K 3025 | | O | | |
| 35 | K 787 | | | | | 85 | K 1879 | | | | | 135 | K 3045 | | | | |
| 36 | K 790 | | | | | 86 | K 1921 | | | | | 136 | K 3050 | | | | |
| 37 | K 798 | | | | | 87 | K 1931 | | | | | 137 | K 3145 | | | | |
| 38 | K 806 | | | | | 88 | K 1935 | | | | | 138 | K 3148 | | | | |
| 39 | K 848 | | | | | 89 | K 1947 | | | | | 139 | K 3149 | O | O | O | |
| 40 | K 855 | | | | | 90 | K 1954 | O | O | O | O | 140 | K 3155 | | | | |
| 41 | K 858 | | | | | 91 | K 1986 | O | O | O | O | 141 | K 3184 | | | | |
| 42 | K 882 | | | | | 92 | K 2001 | O | O | O | O | 142 | K 3193 | | | | |
| 43 | K 898 | O | O | O | O | 93 | K 2044 | | | | | 143 | K 3240 | O | O | O | O |
| 44 | K 907 | | | | | 94 | K 2049 | O | O | O | | 144 | K 3263 | | | | |
| 45 | K 908 | | | O | | 95 | K 2052 | | | | | 145 | K 3274 | | | | |
| 46 | K 936 | O | O | O | O | 96 | K 2055 | | | | | 146 | K 3321 | | | | |
| 47 | K 1011 | O | | | O | 97 | K 2065 | | | O | | 147 | K 3336 | | | | |
| 48 | K 1079 | O | O | O | O | 98 | K 2069 | | | | | 148 | K 3340 | | | | |
| 49 | K 1083 | O | O | O | O | 99 | K 2092 | | | | | 149 | K 3344 | | | | |
| 50 | K 1097 | O | O | O | O | 100 | K 2121 | O | | | | 150 | K 3404 | O | O | O | O |
| | | | | | | | | | | | | | total | 61 | 56 | 57 | 58 |

Figure 31 continued

| Sample | 1 | | | 2 | | | 3 | | | 4 | | |
|---|---|---|---|---|---|---|---|---|---|---|---|---|
| KLH1/KLH2 | KLH1 | KLH2 | total | KLH1 | KLH2 | total | KLH1 | KLH2 | total | KLH1 | KLH2 | total |
| Total K | 156 | 150 | 306 | 156 | 150 | 306 | 156 | 150 | 306 | 156 | 150 | 306 |
| Globo H-conjugated K | 14 | 17 | 31 | 7 | 12 | 19 | 4 | 6 | 10 | 8 | 10 | 18 |
| MMCCH-conjugated K | 86 | 69 | 155 | 83 | 60 | 143 | 86 | 61 | 147 | 84 | 56 | 140 |

| Sample | 1 | | | 2 | | | 3 | | | 4 | | |
|---|---|---|---|---|---|---|---|---|---|---|---|---|
| KLH1/KLH2 | KLH1 | KLH2 | total | KLH1 | KLH2 | total | KLH1 | KLH2 | total | KLH1 | KLH2 | total |
| Total K | 156 | 150 | 306 | 156 | 150 | 306 | 156 | 150 | 306 | 156 | 150 | 306 |
| Globo H-conjugated K | 13 | 15 | 28 | 7 | 14 | 21 | 6 | 5 | 11 | 9 | 10 | 19 |
| MMCCH-conjugated K | 80 | 61 | 141 | 81 | 56 | 137 | 86 | 57 | 143 | 78 | 58 | 136 |

The "Total K" indicates the numbers of lysine residues from KLH1 and KLH2 sequences. The "Globo H-conjugated K" indicates the numbers of identified Globo H conjugated lysines. The "MMCCH-conjugated K" indicates the numbers of identified MMCCH conjugated lysines.

Figure 32

Globo H derivative

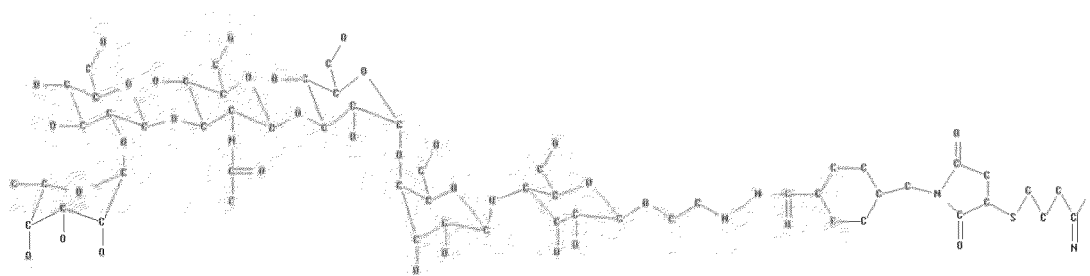

Chemical formula: C(56) H(91) N(5) O(33) S(1)
Monoisotopic MW addition: 1393.5317 Da

The neutral loss forms of Globo H derivative

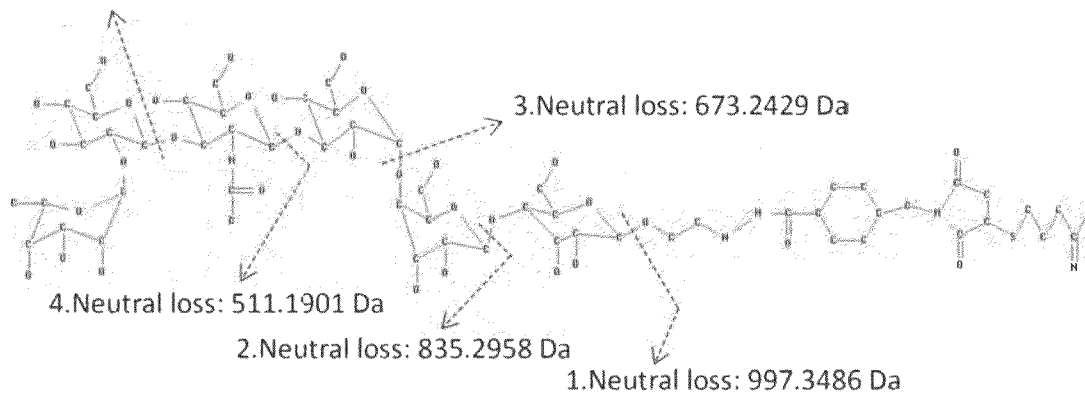

1. Chemical formula: C(18) H(28) N(4) O(4) S(1)
   Monoisotopic MW addition: 396.1831 Da 2. Chemical formula: C(24) H(38) N(4) O(9) S(1)
   Monoisotopic MW addition: 558.2360 Da 3. Chemical formula: C(30) H(48) N(4) O(14) S(1)
   Monoisotopic MW addition: 720.2888 Da 4. Chemical formula: C(36) H(58) N(4) O(19) S(1)
   Monoisotopic MW addition: 882.3416 Da 5. Chemical formula: C(44) H(71) N(5) O(24) S(1)
   Monoisotopic MW addition: 1085.4210 Da

Figure 33

MMCCH derivative
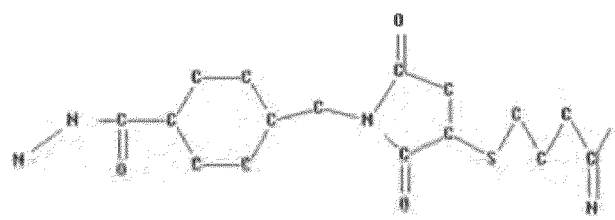
Chemical formula: C(16) H(24) N(4) O(3) S(1)
Monoisotopic MW addition: 352.1569 Da
deamidated MMCCH derivative
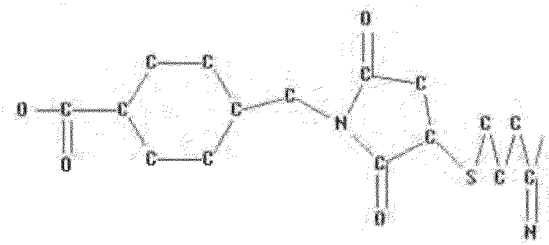
Chemical formula: C(16) H(22) N(2) O(4) S(1)
Monoisotopic MW addition: 338.1300 Da
Figure 34

COMPOSITIONS OF A CARBOHYDRATE VACCINE FOR INDUCING IMMUNE RESPONSES AND USES THEREOF IN CANCER TREATMENT

This application claims benefit of U.S. Provisional Patent Application No. 61/878,982, filed Sep. 17, 2013, the disclosure of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Dec. 10, 2014, is named 0151-0001US1 SL.txt and is 554,898 bytes in size.

FIELD OF THE INVENTION

The invention encompasses compositions and methods for cancer immunotherapy in general and immunogenic glycoconjugates able to elicit anti-cancer immune responses in particular.

BACKGROUND OF THE INVENTION

The use of synthetic carbohydrate conjugates to elicit antibodies was first demonstrated by Goebel and Avery in 1929. (Goebel, W. F., and Avery, O. T., J. Exp. Med., 1929, 50, 521; Avery, O. T., and Goebel, W. F., J. Exp. Med., 1929, 50, 533.) Carbohydrates were linked to carrier proteins via the benzenediazonium glycosides. Immunization of rabbits with the synthetic antigens generated polyclonal antibodies. Other workers (Allen, P. Z., and Goldstein, I. J., Biochemistry, 1967, 6, 3029; Rude, E., and Delius, M. M., Carbohydr. Res., 1968, 8, 219; Himmelspach, K., et al., Eur. J. Immunol., 1971, 1, 106; Fielder, R. J., et al., J. Immunol., 1970, 105, 265) developed similar techniques for conjugation of carbohydrates to protein carriers.

Glycoconjugates may be used in active immunotherapy generated from vaccinations to specifically target known target agents on tumor cells. The response to carbohydrate antigens normally does not enlist the use of T-cells, which would aid in the body's rejection of the tumor. While the probability of complete tumor rejection as a result of vaccination with a conjugate is thought to be unlikely, such treatments will boost immune surveillance and recurrence of new tumor colonies can be reduced. (Dennis, J., Oxford Glycosystems Glyconews Second, 1992; Lloyd, K. O., in Specific Immunotherapy of Cancer with Vaccines, 1993, New York Academy of Sciences, 50-58). Toyokuni and Singhal have described a synthetic glycoconjugate (Toyokuni, T., et al., J. Am. Chem. Soc., 1994, 116, 395) that stimulated a measurable IgG titer, a result which is significant since an IgG response is generally associated with enlistment of helper T cells.

The carbohydrate antigen Globo H (Fuc$\alpha$1→2 Gal$\beta$1→3 GalNAc$\beta$1→3 Gal$\alpha$1→4 Gal$\beta$1→4 Glc) was first isolated as a ceramide-linked Glycolipid and identified in 1984 by Hakomori et al. from breast cancer MCF-7 cells. (Bremer E G, et al. (1984) J Biol Chem 259:14773-14777). Further studies with anti-Globo H monoclonal antibodies showed that Globo H was present on many other cancers, including prostate, gastric, pancreatic, lung, ovarian and colon cancers and only minimal expression on luminal surface of normal secretory tissue which is not readily accessible to immune system. (Ragupathi G, et al. (1997) Angew Chem Int Ed 36:125-128). In addition, it has been established that the serum of breast cancer patient contains high level of anti-Globo H antibody. (Gilewski T et al. (2001) Proc Natl Acad Sci USA 98:3270-3275; Huang C-Y, et al. (2006) Proc Natl Acad Sci USA 103:15-20; Wang C-C, et al. (2008) Proc Natl Acad Sci USA 105(33):11661-11666). Patients with Globo H-positive tumors showed a shorter survival in comparison to patients with Globo H-negative tumors. (Chang, Y-J, et al. (2007) Proc Natl Acad Sci USA 104(25):10299-10304). These findings render Globo H, a hexasaccharide epitope, an attractive tumor marker and a feasible target for cancer vaccine development.

A synthetic Globo H vaccine in combination with an immunological adjuvant was shown to induce mainly IgM and to a lesser extent IgG antibodies in both prostate and metastatic breast cancer patients. In a phase I clinical trial, the vaccine also showed minimal toxicity with transient local skin reactions at the vaccination site. (Gilewski T et al. (2001) Proc Natl Acad Sci USA 98:3270-3275; Ragupathi G, et al. (1997) Angew Chem Int Ed 36:125-128; Slovin S F et al (1997) Proc Natl Acad Sci USA 96:5710-5715). Mild flu-like symptoms which have been observed in some of the patients were probably associated with the side effect of QS-21. A pentavalent vaccine containing five prostate and breast cancer associated carbohydrate antigens—Globo-H, GM2, STn, TF and Tn—conjugated to maleimide-modified carrier protein KLH has been reported to produce anti-Globo H sera with higher titers of IgG than IgM in ELISA assays. (Zhu J. et al. (2009) J. Am. Chem. Soc. 131(26):9298-9303).

It is known that KLH contains glycosylated polypeptide subunits that assemble to form decameric (10-mer), didecameric (20-mer), and larger particles. These multimeric structures have been characterized by ultracentrifugation techniques that yield sedimentation coefficients of 11-19S for the dissociated subunits and 92-107S for the didecameric multimers. It is further known that a variety of factors may affect the size distribution of molluscam hemocyanins, including KLH. These factors include ionic strength, pH, temperature, $pO_2$, and the availability of certain divalent cations, notably calcium and magnesium. The current inventors have developed a composition with increased efficacy that is primarily comprised of dimers and trimers of KLH linked to a plurality of Globo H moieties.

While vaccines have been developed to elicit antibody responses against Globo H, their anti-cancer efficacies are unsatisfactory due to low antigenicity of Globo H. There is a need for a new vaccine capable of eliciting high levels of immune responses targeting Globo H.

SUMMARY OF THE INVENTION

The invention generally encompasses therapeutic and/or prophylactic compositions including Globo H, as well as, immunotherapeutics, vaccines, dosage forms, kits, and methods of manufacture, and treatment thereof.

In one embodiment, the invention encompasses an isolated therapeutic conjugate comprising a Globo H moiety linked to a keyhole limpet hemocyanin (KLH) moiety subunit. In certain embodiments, the linkage is a covalent bond.

In another embodiment, the invention encompasses an isolated therapeutic conjugate comprising a Globo H moiety covalently linked to a keyhole limpet hemocyanin (KLH) moiety subunit, wherein the KLH is a derivatized KLH. As used herein the term "covalently linked" when referring to Globo-H and KLH means: Globo-H is directly covalently linked to KLH, or Globo-H is covalently linked to derivatized KLH (as set forth herein), or Globo-H is covalently linked to KLH through a linker group (as set forth herein), or Globo-H is covalently linked to KLH through both a linker group and a derivatized KLH.

In certain illustrative embodiments, the derivatized KLH of the invention has the following structure:

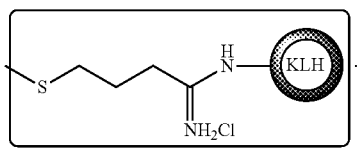
Derivatized KLH

In another embodiment, the invention encompasses an isolated therapeutic conjugate comprising a Globo H moiety covalently linked to a keyhole limpet hemocyanin (KLH) moiety subunit through a linker molecule.

In a preferred embodiment the Globo H moieties are bound to a lysine residue of a KLH moiety subunit.

In one embodiment, there are total of exactly or about 145, 146, 147, 148, 149, 150, 151, 152, 153, 154, 155, 156, 157, 158, 159, 160 total lysine residues per KLH moiety subunit which are available for or actually directly or indirectly bind a Globo H moiety.

In another embodiment, the invention encompasses an isolated therapeutic conjugate comprising a Globo H moiety covalently linked to a keyhole limpet hemocyanin (KLH) moiety subunit via a 4-(4-N-maleimidomethyl) cyclohexane-1-carboxyl hydrazide (MMCCH) linker group. The MMCCH linker of the invention has the following structure:

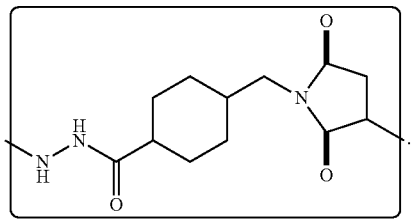
MMCCH linker

In another illustrative embodiment, the invention encompasses an isolated therapeutic conjugate having the following general structure:

wherein n is an integer from about 1 to about 160. In certain embodiments, a monomeric KLH moiety can include from about 1 to about 160 Globo H moieties. One of ordinary skill in the art will recognize that the structures are illustrated as the iminium hydrochloride salts but can also exist or co-exist as the imine form. Accordingly, the invention encompasses both the imine as well as salts thereof including the iminium hydrochloride salt. In certain embodiments, a monomeric KLH moiety can include from about 1 to about 125 Globo H moieties. In certain embodiments, a monomeric KLH moiety can include from about 1 to about 100 Globo H moieties. In certain embodiments, a monomeric KLH moiety can include from about 1 to about 75 Globo H moieties. In certain embodiments, a monomeric KLH moiety can include from about 1 to about 50 Globo H moieties. In certain embodiments, a monomeric KLH moiety can include from about 1 to about 25 Globo H moieties. In certain embodiments, a monomeric KLH moiety can include from about 1 to about 10 Globo H moieties.

In certain embodiments, the Globo H moieties are conjugated to the KLH moieties covalently on basic amino acid residues. In certain embodiments, the basic amino acid residues are arginine, lysine, histidine, or a combination thereof.

In another embodiment the Globo H moieties are bound to lysine conjugation sites on a monomeric KLH moiety subunit.

In another embodiment, there are exactly or about 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109 or 110 lysine conjugation sites on each monomeric KLH moiety subunit available for binding to or actually bound to a Globo H moiety. In another embodiment, there are 62, 66, 67, 68, 70, 72, 76, 86, 87, 88, 90, 92, 93, 100 such lysine conjugation sites on each KLH moiety subunit.

In certain therapeutic composition embodiments containing a mixture of moiety subunits (e.g., KLH1 and KLH2 or variants thereof), total available lysine (for both subunits) as are counted together across the different subunit types the and may be or are exactly about 290, 291, 292, 293, 294, 295, 296, 297, 298, 299, 300, 301, 302, 303, 304, 305, 306, 307, 308, 309 or 310 in number. In such embodiments, there are or may be exactly or about 130, 131, 132, 133, 134, 135, 136, 137, 138, 139, 140, 141, 142, 143, 144, 145, 146, 147, 148, 149, 150, 151, 152, 153, 154, 155, 156, 157, 158, 159 or 160 lysine conjugation sites together across the different subunits (e.g., KLH1 and KLH2 or variants thereof). In other such embodiments, there are 136, 137, 141, 140, 143, 147 or 155 lysine conjugation sites.

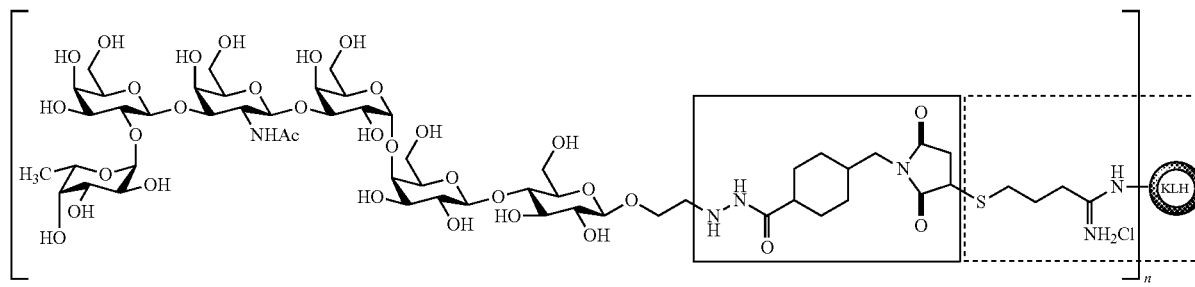

In another illustrative embodiment, the invention encompasses an isolated therapeutic conjugate having the following general structure:

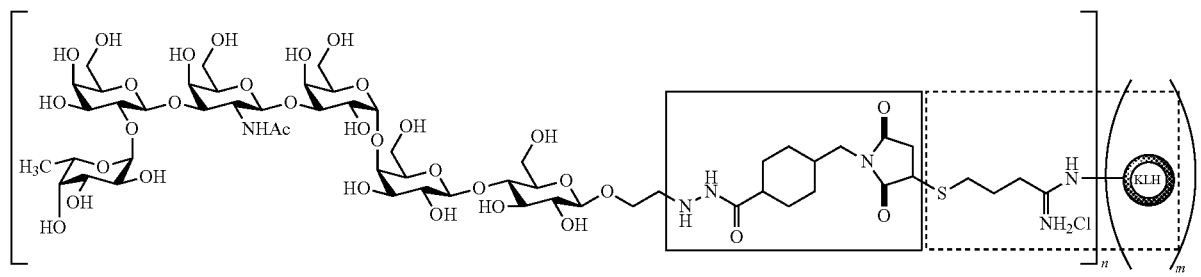

wherein n is independently an integer from about 1 to about 3000 and m is independently an integer from about 1 to about 20. In certain embodiments, when m is greater than 1, KLH moieties can aggregate to form multimeric structures. In certain embodiments, the aggregation is a covalent bond. In certain other embodiments, the aggregation is not a covalent bond (e.g., the aggregation is formed by H-bonding or hydrophobic interactions). In certain embodiments, a monomeric KLH moiety (i.e., where m=1) can include from about 1 to about 160 Globo H moieties. In certain embodiments, a dimeric KLH moiety (i.e., where m=2) can include from about 1 to about 300 Globo H moieties. In certain embodiments, a trimeric KLH moiety (i.e., where m=3) can include from about 1 to about 450 Globo H moieties. In certain embodiments, a tetrameric KLH moiety (i.e., where m=4) can include from about 1 to about 600 Globo H moieties. In certain embodiments, a pentameric KLH moiety (i.e., where m=5) can include from about 1 to about 750 Globo H moieties.

In another illustrative embodiment, the invention encompasses an isolated therapeutic conjugate having the following general structure:

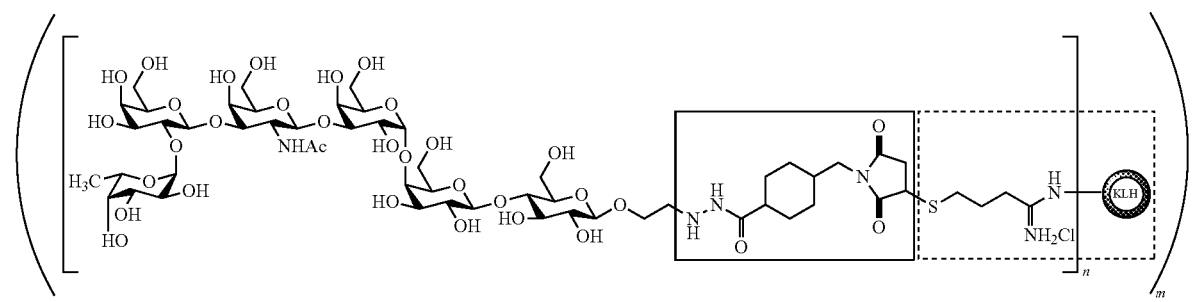

wherein n is independently an integer from about 1 to about 150 and m is independently an integer from about 1 to about 20.

In another embodiments, the invention encompasses an isolated therapeutic conjugate having the following general structure:

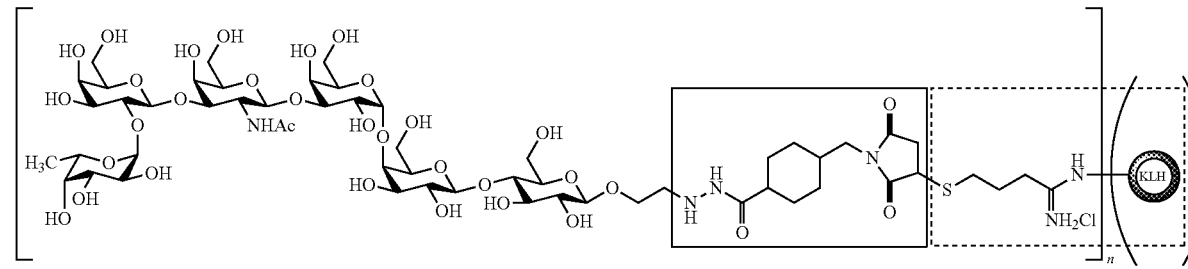

wherein n independently is an integer from about 1 to about 160, and wherein m is independently an integer from about 1 to about 20. In certain embodiments, m is an integer from about 1 to about 5. In certain embodiments, m is an integer from about 1 to about 3. In certain embodiments, m is 1. In certain embodiments, m is 2. In certain embodiments, m is 3. In certain embodiments, m is 4. In certain embodiments, m is 5. In certain embodiments, m is 6. In certain embodiments, m is 7. In certain embodiments, m is 8. In certain embodiments, m is 9. In certain embodiments, m is 10. In certain embodiments, m is 11. In certain embodiments, m is 12. In certain embodiments, m is 13. In certain embodiments, m is 14. In certain embodiments, m is 15. In certain embodiments, m is 16. In certain embodiments, m is 17. In certain embodiments, m is 18. In certain embodiments, m is 19. In certain embodiments, m is 20. In certain embodiments, for any of the above embodiments, when m is 1 to 20, each n is 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, or 160, respectively.

In certain embodiments, there is more than one Globo H moiety attached to each monomeric KLH moiety. In certain illustrative embodiments, the more than one Globo H moiety attached to each KLH moiety is attached via a linker. In other illustrative embodiments, the more than one Globo H moieties attached to each KLH moiety are attached via a linker and attached to a derivatized KLH moiety.

In another embodiment, the ratio of Globo H moieties to KLH moiety subunits is at least 1. In another embodiment, the ratio of Globo H moieties to KLH moiety subunits is at least 10. In another embodiment, the ratio of Globo H moieties to KLH moiety is at least 25. In another embodiment, the ratio of Globo H moieties to KLH moiety subunits is at least 50. In a further embodiment, the ratio of Globo H moieties to KLH moiety subunits is at least 100. In a further embodiment, the ratio of Globo H moieties to KLH moiety subunits is at least 150. In yet another embodiment, the ratio of Globo H moieties to KLH moiety subunits is at least 500. In yet a further embodiment, the ratio of Globo H moieties to KLH moiety subunits is at least 750. In still another embodiment, the ratio of Globo H moieties to KLH moiety subunits is at least 1000. In still another embodiment, the ratio of Globo H moieties to KLH moiety subunits is at least 1500. In still another embodiment, the ratio of Globo H moieties to KLH moiety subunits is at least 2000.

In various embodiments, the invention encompasses a single monomer of KLH to multiple KLH subunits (e.g., 2, 3, 4, 5, 6, 7, 8, 9, 10, 11, 12, 13, 14, 15, 16, 17, 18, 19, 20) each having attached multiple Globo H moieties. In certain embodiments, the ratio of Globo H moieties to KLH moiety is the same. In other embodiments, the ratio of Globo H moieties to KLH moiety is different.

Another embodiment of the invention encompasses a composition comprising at least two KLH moieties. For example, a derivatized KLH moiety in the form of a dimer. In another embodiment, the at least two KLH moieties are the same. In another embodiment, the at least two KLH moieties are different. In a further embodiment, the at least two KLH moieties have the same Globo H moiety to KLH moiety subunit ratio. In still a further embodiment, the at least two KLH moieties have a different Globo H moiety to KLH moiety subunit ratio.

Another embodiment of the invention encompasses a therapeutic composition comprising at least three KLH moieties, for example, a derivatized KLH moiety in the form of a trimer. In certain embodiments, the at least three KLH moieties are the same. In another embodiment, the at least three KLH moieties are not the same. In a further embodiment, the at least three KLH moieties have the same Globo H moiety to KLH moiety subunit ratio. In still a further embodiment, the at least three KLH moieties have a different Globo H moiety to KLH moiety subunit ratio.

Another embodiment of the invention encompasses a therapeutic composition comprising at least four KLH moieties, for example, a derivatized KLH moiety in the form of a tetramer. In certain embodiments, the at least four KLH moieties are the same. In another embodiment, the at least four KLH moieties are not the same. In a further embodiment, the at least four KLH moieties have the same Globo H moiety to KLH moiety subunit ratio. In still a further embodiment, the at least four KLH moieties have a different Globo H moiety to KLH moiety subunit ratio.

Another embodiment of the invention encompasses a therapeutic composition comprising at least five KLH moieties, for example, a derivatized KLH moiety in the form of a pentamer. In certain embodiments, the at least five KLH moieties are the same. In another embodiment, the at least five KLH moieties are not the same. In a further embodiment, the at least five KLH moieties have the same Globo H moiety to KLH moiety subunit ratio. In still a further embodiment, the at least five KLH moieties have a different Globo H moiety to KLH moiety subunit ratio.

Another embodiment of the invention encompasses a therapeutic composition comprising at least six KLH moieties, for example, a derivatized KLH moiety in the form of a hexamer. In certain embodiments, the at least six KLH moieties are the same. In another embodiment, the at least six KLH moieties are not the same. In a further embodiment, the at least six KLH moieties have the same Globo H moiety to KLH moiety subunit ratio. In still a further embodiment, the at least six KLH moieties have a different Globo H moiety to KLH moiety subunit ratio.

In one embodiment, the Globo H moiety comprises (Fucα1→2 Galβ1→3 GalNAcβ1→3 Galα1→4 Galβ1→4 Glc). In a further embodiment, the KLH moiety subunit is a KLH-1 or KLH-2 moiety or a combination thereof. As used herein, the term "KLH" refers to KLH-1, KLH-2, and/or combinations thereof.

In another embodiment, the KLH moiety subunit is at least 99% identical to a corresponding naturally occurring KLH moiety subunit.

In another embodiment, the KLH moiety subunit is at least 95% identical to a corresponding naturally occurring KLH moiety subunit.

In another embodiment, the KLH moiety subunit is at least 90% identical to a corresponding naturally occurring KLH moiety subunit.

In another embodiment, the KLH moiety subunit is at least 80% identical to a corresponding naturally occurring KLH moiety subunit.

In another embodiment, the KLH moiety subunit is at least 70% identical to a corresponding naturally occurring KLH moiety subunit.

In another embodiment, the KLH moiety subunit is at least 60% identical to a corresponding naturally occurring KLH moiety subunit.

In another embodiment, the Globo H moiety is covalently linked to a keyhole limpet hemocyanin (KLH) moiety subunit via a linker. In yet a further embodiment, the Globo H moiety is covalently linked to a keyhole limpet hemocyanin (KLH) moiety subunit by a 4-(4-N-maleimidomethyl) cyclohexane-1-carboxyl hydrazide (MMCCH) linkage. In another further embodiment, the Globo H moiety is covalently linked to a derivatized keyhole limpet hemocyanin (KLH) moiety subunit and is linked by a 4-(4-N-maleimidomethyl) cyclohexane-1-carboxyl hydrazide (MMCCH) linkage.

In another embodiment, the isolated therapeutic conjugate has an epitope ratio based on a KLH monomer having molecular weight of about 350 KDa to about 400 KDa of at least or about 150. In another embodiment, the isolated therapeutic conjugate has an epitope ratio of at least or about 100. In a further embodiment, the isolated therapeutic conjugate has an epitope ratio of at least or about 75. In still a further embodiment, the isolated therapeutic conjugate has an epitope ratio of at least or about 50. In yet a further embodiment, the isolated therapeutic conjugate has an epitope ratio of at least or about 25. In still another embodiment, the isolated therapeutic conjugate has an epitope ratio of at least or about 15. In still another embodiment, the isolated therapeutic conjugate has an epitope ratio of at least or about 5. In still another embodiment, the isolated therapeutic conjugate has an epitope ratio of at least or about 1.

Another embodiment of the invention encompasses a pharmaceutical composition comprising KLH moiety subunits, wherein each KLH moiety subunit comprises one or more Globo H moieties covalently linked to a keyhole limpet hemocyanin (KLH) moiety subunit. In certain embodiments, the pharmaceutical composition comprises dimers of at least two KLH moiety subunits, wherein each KLH moiety subunits comprises one or more Globo H moieties covalently linked to a KLH moiety subunit. In certain embodiments, the pharmaceutical composition comprises trimers of at least three KLH moiety subunits, wherein each KLH moiety subunits comprises one or more Globo H moieties covalently linked to a KLH moiety subunit. In certain embodiments, the pharmaceutical composition comprises at least four KLH moiety subunits, wherein each KLH moiety subunit comprises one or more Globo H moieties covalently linked to a KLH moiety subunit. In certain embodiments, the pharmaceutical composition comprises a mixture of KLH moiety subunits (e.g., monomers, dimers, trimers, tetramers, pentamers etc.), wherein each KLH moiety subunits comprises multiple Globo H moieties covalently linked to a KLH moiety subunit.

Another aspect of the invention relates to a pharmaceutical composition comprising monomers, dimers, trimers, tetramers, or pentamers or combinations thereof of KLH moieties, wherein each KLH comprises one or more Globo H moiety covalently linked to a keyhole limpet hemocyanin (KLH) moiety subunit.

In one embodiment the invention, the epitope ratios of the therapeutic conjugates in the composition ranges from about 1 to 3000. In a further embodiment, the epitope ratios of the therapeutic conjugates in the composition range from about 75 to 2000. In still another embodiment, the epitope ratios of the therapeutic conjugates in the composition range from about 100 to 1000. In yet a further embodiment the average epitope ratio of the therapeutic conjugates in the composition ranges from about 150 to 500.

In another embodiment, about 1% to 99% of the therapeutic conjugates in the composition are KLH monomers. In a further embodiment, about 0% to 99% of the therapeutic conjugates in the composition are KLH dimers. In still another embodiment, about 0% to 99% of the therapeutic conjugates in the composition are KLH trimers. In yet another embodiment, about 0% to 99% of the therapeutic conjugates in the composition are KLH tetramers. In a further embodiment, about 1% to 99% of the therapeutic conjugates in the composition are KLH pentamers. In yet another embodiment, about 0% to 99% of the therapeutic conjugates in the composition include 6 KLH subunits. In yet another embodiment, about 0% to 99% of the therapeutic conjugates in the composition include 7 KLH subunits. In yet another embodiment, about 0% to 99% of the therapeutic conjugates in the composition include 8 KLH subunits. In yet another embodiment, about 0% to 99% of the therapeutic conjugates in the composition include 9 KLH subunits. In yet another embodiment, about 0% to 99% of the therapeutic conjugates in the composition include 10 KLH subunits. In yet another embodiment, about 0% to 99% of the therapeutic conjugates in the composition include 11 KLH subunits. In yet another embodiment, about 0% to 99% of the therapeutic conjugates in the composition include 12 KLH subunits. In yet another embodiment, about 0% to 99% of the therapeutic conjugates in the composition include 13 KLH subunits. In yet another embodiment, about 0% to 99% of the therapeutic conjugates in the composition include 14 KLH subunits. In yet another embodiment, about 0% to 99% of the therapeutic conjugates in the composition include 15 KLH subunits. In yet another embodiment, about 0% to 99% of the therapeutic conjugates in the composition include 16 KLH subunits. In yet another embodiment, about 0% to 99% of the therapeutic conjugates in the composition include 17 KLH subunits. In yet another embodiment, about 0% to 99% of the therapeutic conjugates in the composition include 18 KLH subunits. In yet another embodiment, about 0% to 99% of the therapeutic conjugates in the composition include 19 KLH subunits. In yet another embodiment, about 0% to 99% of the therapeutic conjugates in the composition include 20 KLH subunits. In still another embodiment, about 1% to 99% of the therapeutic conjugates in the composition are monomers, dimers, trimers, tetramers or combinations thereof. In still another embodiment, about 99% of the therapeutic conjugates in the composition are monomers, dimers, trimers, tetramers or combinations thereof.

In another embodiment, the pharmaceutical composition comprises an adjuvant including, but not limited to, Freund's adjuvant, Toll-Like Receptor molecules, LPS, lipoproteins, lipopeptides, flagellin, double-stranded RNA, viral DNA, unmethylated CpG islands, levamisole, bacillus Calmette-Guerin, Isoprinosine, Zadaxin, PD-1 antagonists, PD-1 antibodies, CTLA antagonists, CTLA antibodies, interleukin, cytokines, GM-CSF, glycolipid, aluminum salt based, aluminum phosphate, alum, aluminum hydroxide, liposomes, TLR2 agonists, lipopeptide, nanoparticles, monophosphoryl lipid A, OBI-821 saponin, QS-21 saponin, oil in water nano-emulsions, and bacteria-like particle.

In another embodiment, the pharmaceutical composition comprises a cytokine selected from the group consisting of IL-2, IL-12, IL-18, IL-2, IFN-γ, TNF, IL-4, IL-10, IL-13, IL-21, GM-CSF and TGF-β. In a further embodiment, the pharmaceutical composition comprises a chemokine.

In a further embodiment, the therapeutic agent is administered as a pharmaceutical composition.

In still another embodiment, the pharmaceutical composition comprises monoclonal antibodies, chemotherapeutics, hormonal therapeutic agents, retinoid receptor modulators, cytotoxic/cytostatic agents, antineoplastic agents, antiproliferative agents, anti-mTOR agents, anti-Her2 agents, anti-EGFR agents, prenyl-protein transferase inhibitors, HMG-CoA reductase inhibitors, nitrogen mustards, nitroso ureas, angiogenesis inhibitors, bevacizumab, inhibitors of cell proliferation and survival signaling pathway, apoptosis inducing agents, agents that interfere with cell cycle checkpoints, agents that interfere with receptor tyrosine kinases (RTKs), integrin blockers, NSAIDs, PPAR agonists, inhibitors of inherent multidrug resistance (MDR), anti-emetic agents, agents useful in the treatment of anemia, agents useful in the treatment of neutropenia, immunologic-enhancing drugs, biphosphonates, aromatase inhibitors, agents inducing terminal differentiation of neoplastic cells, γ-secretase inhibitors, cancer vaccines (e.g., active immunotherapy), monoclonal antibody therapeutics (e.g., passive immunotherapy), and any combination thereof.

In another embodiment, the therapeutic compositions of the invention can further include PD-1/PD-L1 inhibitors (cytotoxic T cell lymphocyte (CTLs) immunotherapy), CTLA-4 immunotherapy, CDK4/6 inhibitors (target therapy), PI3K inhibitors (target therapy), mTOR inhibitors (target therapy), AKT inhibitors (target therapy), Pan-Her inhibitors (target therapy). These inhibitors can be modified to generate the respective monoclonal antibody as well. Such antibodies can be included in therapeutic compositions of the invention.

In another embodiment, the pharmaceutical composition comprises a pharmaceutically acceptable carrier. In a further embodiment, the pharmaceutical composition is a cancer vaccine. In still another embodiment, the pharmaceutical composition is formulated for subcutaneous administration. In still another embodiment, the pharmaceutical composition is formulated for intramuscular administration. In still another embodiment, the pharmaceutical composition is formulated for intra-arterial administration. In still another embodiment, the pharmaceutical composition is formulated for intravenous administration.

Another embodiment of the invention encompasses a method of treating a patient in need thereof comprising administering to the patient a therapeutically effective amount of the therapeutic composition comprising Globo H and KLH. In one embodiment, the patient has been diagnosed with or is suspected of having cancer. In another embodiment, the cancer is an epithelial cancer. In a further embodiment, the cancer is breast cancer. In still another embodiment, the therapeutically effective amount of a Globo-H moiety in the pharmaceutical/therapeutic composition may range from about 0.001 µg/kg to about 250 mg/kg. In yet a further embodiment, the therapeutically effective amount Globo-H moiety in the pharmaceutical/therapeutic composition comprises about 10 µg/kg to about 50 µg/kg of one therapeutic conjugate per dose. In yet a further embodiment, the therapeutically effective amount Globo-H moiety in the pharmaceutical/therapeutic composition comprises about 0.10 µg/kg to about 0.75 µg/kg of one therapeutic conjugate per dose.

In still another embodiment, the therapeutically effective amount of the Globo-H-KLH complex in the therapeutic composition may range from about 0.001 µg/kg to about 250 mg/kg. In yet a further embodiment, the therapeutically effective amount of the Globo-H-KLH complex in the therapeutic composition comprises about 10 µg/kg to about 50 µg/kg of one therapeutic conjugate per dose. In yet a further embodiment, the therapeutically effective amount of the Globo-H-KLH complex in the therapeutic composition comprises about 0.60 µg/kg to about 4.50 µg/kg of one therapeutic conjugate per dose.

In still another embodiment, the method is capable of extending progression free survival over a control placebo by about or at least 1 week. In still another embodiment, the method is capable of extending progression free survival over a control placebo by about or at least 2 weeks. In still another embodiment, the method is capable of extending progression free survival over a control placebo by about or at least 1 month. In still another embodiment, the method is capable of extending progression free survival over a control placebo by about or at least 3 months. In still another embodiment, the method is capable of extending progression free survival over a control placebo by about or at least 6 months. In yet another embodiment, the method is capable of extending or overall survival over a control placebo by about or at least 12 months.

BRIEF DESCRIPTION OF THE FIGURES

A more complete understanding of the invention may be obtained by reference to the accompanying drawings, when considered in conjunction with the subsequent detailed description. The embodiments illustrated in the drawings are intended only to exemplify the invention and should not be construed as limiting the invention to the illustrated embodiments.

FIG. 2B shows Globo H-KLH dimers and trimers of the invention compared to Globo H conjugates disclosed in Slovin et al (1999), Proc Natl Acad Sci USA 96:5710-5 and Gilewski et al (2001), Proc Natl Acad Sci USA 98: 3270-5.

FIG. 5A-D shows the chronological expansion of B/CD3$^+$ T/CD4$^+$ T/CD8$^+$ T cell populations in Lewis rats immunized with a Globo H-KLH glycoconjugate according to the invention. Panels A-D represented B cell, CD3 T cell, CD4 T cell, and CD8 T cell populations, respectively. Data were presented as percentage of cell numbers in indicated group normalized to the percentage of cell numbers of PBS group. Multiple comparisons were analyzed using two-way ANOVA, followed by Bonferroni's post hoc tests. *, $p<0.05$, , $p<0.01$, and *, $p<0.001$ compared with PBS.

FIG. 6A-B shows the chronological changes in reciprocal titers of (A) IgM and (B) IgG antibodies in the blood from Lewis rats immunized with the glycoconjugate (Globo H-KLH) of the invention.

FIG. 13 shows a Table Summary of peptide identification.

FIG. 14 illustrates the identification details of Globo-H conjugated peptides for sample 1 (1st LC-MS/MS) for KLH1 (a) and KLH2 (b). FIG. 14 discloses SEO ID NO: 3-32, respectively, in order of appearance.

FIG. 15 illustrates the identification details of Globo-H conjugated peptides for sample 2 (1st LC-MS/MS) for KLH1 (a) and KLH2 (b). FIG. 15 discloses SEO ID NO: 33-53, respectively, in order of appearance.

FIG. 16 illustrates the identification details of Globo-H conjugated peptides for sample 3 (1st LC-MS/MS) for KLH1 (a) and KLH2 (b). FIG. 16 discloses SEO ID NO: 54-64, respectively, in order of appearance.

FIG. 17 illustrates the identification details of Globo-H conjugated peptides for sample 4 (1st LC-MS/MS) for KLH1 (a) and KLH2 (b). FIG. 17 discloses SEO ID NO: 65-83, respectively, in order of appearance.

FIG. 18 illustrates the identification details of Globo-H conjugated peptides for sample 1 (2st LC-MS/MS) for KLH1 (a) and KLH2 (b). FIG. 18 discloses SEO ID NO: 84-111, respectively, in order of appearance.

FIG. 19 illustrates the identification details of Globo-H conjugated peptides for sample 2 (2st LC-MS/MS) for KLH1 (a) and KLH2 (b). FIG. 19 discloses SEO ID NO: 112-133, respectively, in order of appearance.

FIG. 20 illustrates the identification details of Globo-H conjugated peptides for sample 3 (2st LC-MS/MS) for KLH1 (a) and KLH2 (b). FIG. 20 discloses SEO ID NO: 134-144, respectively, in order of appearance.

FIG. 21 illustrates the identification details of Globo-H conjugated peptides for sample 4 (1st LC-MS/MS) for KLH1 (a) and KLH2 (b). FIG. 21 discloses SEO ID NO: 145-164, respectively, in order of appearance.

FIG. 22 FIG. 14 illustrates the identification details of MMCCH-conjugated peptides for sample 1 (1st LC-MS/MS) for KLH1 (a) and KLH2 (b). FIG. 22 discloses SEO ID NO: 165-393, respectively, in order of appearance.

FIG. 23 illustrates the identification details of MMCCH-conjugated peptides for sample 2 (1st LC-MS/MS) for KLH1 (a) and KLH2 (b). FIG. 23 discloses SEO ID NO: 394-597, respectively, in order of appearance.

FIG. 24 illustrates the identification details of MMCCH-conjugated peptides for sample 3 (1st LC-MS/MS) for KLH1 (a) and KLH2 (b). FIG. 24 discloses SEO ID NO: 598-812, respectively, in order of appearance.

FIG. 25 illustrates the identification details of MMCCH-conjugated peptides for sample 4 (1st LC-MS/MS) for KLH1 (a) and KLH2 (b). FIG. 25 discloses SEO ID NO: 813-1008, respectively, in order of appearance.

FIG. 26 illustrates the identification details of MMCCH-conjugated peptides for sample 1 (2st LC-MS/MS) for KLH1 (a) and KLH2 (b). FIG. 26 discloses SEO ID NO: 1009-1212, respectively, in order of appearance.

FIG. 27 illustrates the identification details of MMCCH-conjugated peptides for sample 2 (2st LC-MS/MS) for KLH1 (a) and KLH2 (b). FIG. 27 discloses SEO ID NO: 1213-1404, respectively, in order of appearance.

FIG. 28 illustrates the identification details of MMCCH-conjugated peptides for sample 3 (2st LC-MS/MS) for KLH1 (a) and KLH2 (b). FIG. 28 discloses SEO ID NO: 1405-1616, respectively, in order of appearance.

FIG. 29 illustrates the identification details of MMCCH-conjugated peptides for sample 4 (1st LC-MS/MS) for KLH1 (a) and KLH2 (b). FIG. 29 discloses SEO ID NO: 1617-1803, respectively, in order of appearance.

FIG. 30 illustrates the summary of Globo-H conjugated lysine identification for ($1^{st}$ LC-MS/MS) for KLH1 (a) and KLH2 (b) and ($2^{nd}$ LC-MS/MS) for KLH1 (c) and KLH2 (d).

FIG. 31 illustrates the summary of MMCCH-conjugated lysine identification for ($1^{st}$ LC-MS/MS) for KLH1 (a) and KLH2 (b) and ($2^{nd}$ LC-MS/MS) for KLH1 (c) and KLH2 (d).

FIG. 32 illustrates a summary of the Globo-H conjugation analysis in the first (a) and second (b) LC-MS/MS runs.

FIG. 33(a) illustrates chemical formula: C(56) H(91) N(5) O(33) S(1), Monoisotopic MW addition: 1393.5317 Da. FIG. 33(b) illustrates chemical formula: 1. C(18) H(28) N(4) O(4) S(1), Monoisotopic MW addition: 396.1831 Da; 2. Chemical formula: C(24) H(38) N(4) O(9) S(1), Monoisotopic MW addition: 558.2360 Da; 3. Chemical formula: C(30) H(48) N(4) O(14) S(1), Monoisotopic MW addition: 720.2888 Da; 4. Chemical formula: C(36) H(58) N(4) O(19) S(1), Monoisotopic MW addition: 882.3416 Da; 5. Chemical formula: C(44) H(71) N(5) O(24) S(1), Monoisotopic MW addition: 1085.4210 Da.

FIG. 34(a) illustrates the chemical structure of MMCCH derivative. Chemical formula: C(16) H(24) N(4) O(3) S(1), Monoisotopic MW addition: 352.1569 Da. FIG. 34(b) illustrates a deamidated MMCCH derivative, Chemical formula: C(16) H(22) N(2) O(4) S(1), Monoisotopic MW addition: 338.1300 Da.

DETAILED DESCRIPTION OF THE INVENTION

Figure 1A:
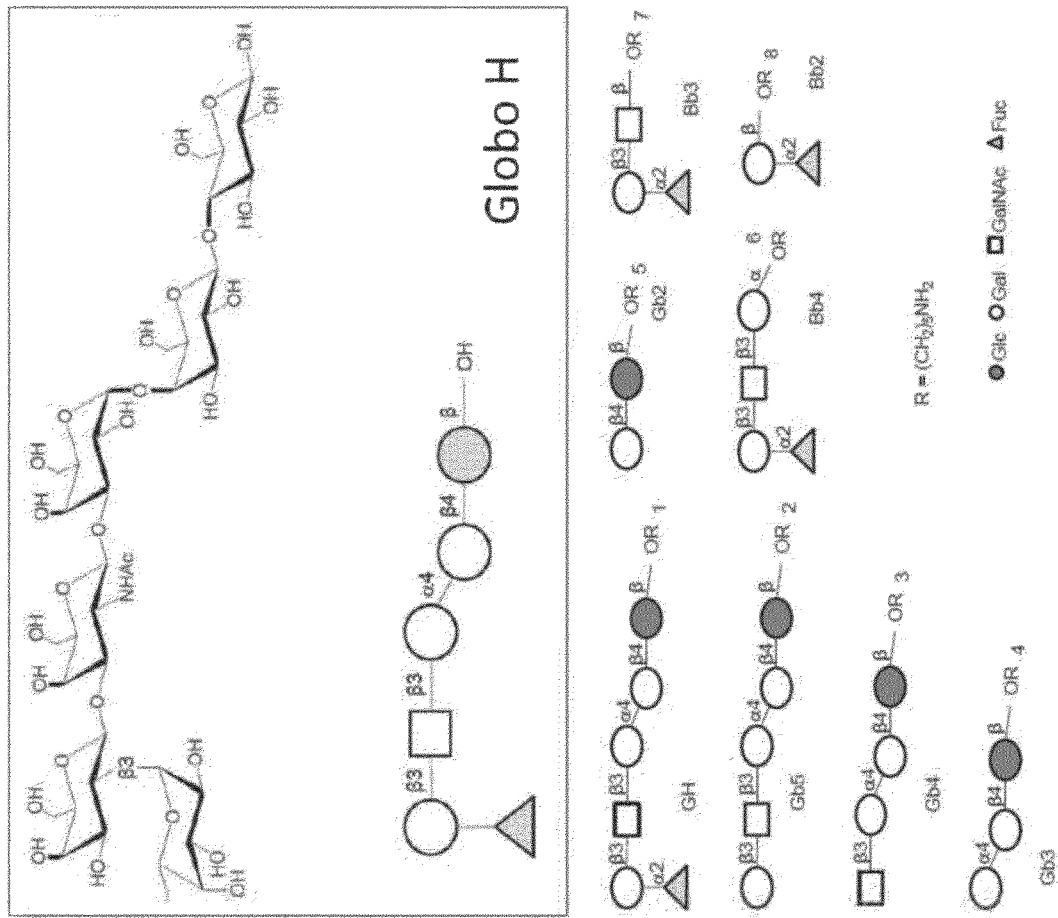
FIG. 1A shows the chemical structure Globo H and as well as several exemplary Globo H analogs. Glc stands for glucose, Gal stands for galactose, GalNAc stands for N-acetylgalactosamine, and Fuc stands for fucose.

The practice of the present invention will employ, unless otherwise indicated, conventional techniques of molecular biology, microbiology, and immunology, which are within the skill of the art. Such techniques are explained fully in the literature. See, for example, Molecular Cloning A Laboratory Manual, 2nd Ed., ed. by Sambrook, Fritsch and Maniatis (Cold Spring Harbor Laboratory Press, 1989); DNA Cloning, Volumes I and II (D. N. Glover ed., 1985); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Antibodies: A Laboratory Manual, by Harlow and Lanes (Cold Spring Harbor Laboratory Press, 1988); and Handbook Of Experimental Immunology, Volumes I-IV (D. M. Weir and C. C. Blackwell, eds., 1986).

The use of the word "a" or "an" when used in conjunction with the term "comprising" in the claims and/or the specification may mean "one," but it is also consistent with the meaning of "one or more," "at least one," and "one or more than one."

Throughout this application, the term "about" is used to indicate that a value includes for example, the inherent variation of error for a measuring device, the method being employed to determine the value, or the variation that exists among the study subjects. Typically the term is meant to encompass approximately or less than 1%, 2%, 3%, 4%, 5%, 6%, 7%, 8%, 9%, 10%, 11%, 12%, 13%, 14%, 15%, 16%, 17%, 18%, 19% or 20% variability depending on the situation.

As used herein, the term "alkyl" refers to a straight or branched monovalent hydrocarbon containing, unless otherwise stated, 1-20 carbon atoms, e.g., $C_1$-$C_8$ or $C_1$-$C_4$, which can be substituted or unsubstituted. Examples of alkyl include, but are not limited to, methyl, ethyl, n-propyl, i-propyl, n-butyl, i-butyl, and t-butyl.

The use of the term "or" in the claims is used to mean "and/or" unless explicitly indicated to refer to alternatives only or the alternatives are mutually exclusive, although the disclosure supports a definition that refers to only alternatives and "and/or."

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the invention, and vice versa. Furthermore, compositions of the invention can be used to achieve methods of the invention.

"Treating" or "treating" is referred to herein as administration of a therapeutic composition to a subject with the purpose to cure, alleviate, relieve, remedy, prevent, or ameliorate a disorder, symptoms of the disorder, a disease state secondary to the disorder, or predisposition toward the disorder.

An "effective amount" is an amount of a therapeutic composition that is capable of producing a medically desirable result as delineated herein in a treated subject. The medically desirable result may be objective (i.e., measurable by some test or marker) or subjective (i.e., subject gives an indication of or feels an effect).

"Disease amenable to treatment with a therapeutic composition" as referred to herein means any procedures, conditions, disorders, ailments and/or illnesses which can be treated by the administration of the therapeutic compositions disclosed herein.

A "proliferative disorder" is one in which too many of some type of cell are produced resulting in deterioration of health. A proliferative disorder can be benign or malignant. Proliferative disorders can include for example, cancer.

A "cancer" that can be treated by the therapeutic compositions disclosed herein, is an abnormal growth of cells. Cancer cells have lost normal control mechanisms and thus are able to expand continuously, invade adjacent tissues, migrate to distant parts of the body, and promote the growth of new blood vessels from which the cells derive nutrients. As used herein, a cancer can be malignant or benign. Cancer can develop from any tissue within the body. As cells grow and multiply, they form a mass of tissue, called a tumor. The term tumor refers to an abnormal growth or mass. Tumors can be cancerous (malignant) or noncancerous (benign). Cancerous tumors can invade neighboring tissues and spread throughout the body (metastasize). Benign tumors, however, generally do not invade neighboring tissues and do not spread throughout the body. Cancer can be divided into those of the blood and blood-forming tissues (leukemias and lymphomas) and "solid" tumors. "Solid" tumors can be carcinomas or sarcomas.

Cancers that may be treated by the therapeutic compositions of the invention include those classified by site include cancer of the oral cavity and pharynx (lip, tongue, salivary gland, floor of mouth, gum and other mouth, nasopharynx, tonsil, oropharynx, hypopharynx, other oral/pharynx); cancers of the digestive system (esophagus; stomach; small intestine; colon and rectum; anus, anal canal, and anorectum; liver; intrahepatic bile duct; gallbladder; other biliary; pancreas; retroperitoneum; peritoneum, omentum, and mesentery; other digestive); cancers of the respiratory system (nasal cavity, middle ear, and sinuses; larynx; lung and bronchus; pleura; trachea, mediastinum, and other respiratory); cancers of the mesothelioma; bones and joints; and soft tissue, including heart; skin cancers, including melanomas and other non-epithelial skin cancers; Kaposi's sarcoma and breast cancer; cancer of the female genital system (cervix uteri; corpus uteri; uterus, ovary; vagina; vulva; and other female genital); cancers of the male genital system (prostate gland; testis; penis; and other male genital); cancers of the urinary system (urinary bladder; kidney and renal pelvis; ureter; and other urinary); cancers of the eye and orbit; cancers of the brain and nervous system (brain; and other nervous system); cancers of the endocrine system (thyroid gland and other endocrine, including *thymus*); lymphomas (Hodgkin's disease and non-Hodgkin's lymphoma), multiple myeloma, and leukemias (lymphocytic leukemia; myeloid leukemia; monocytic leukemia; and other leukemias).

Other cancers, classified by histological type, that may be suitable targets for the therapeutic compositions according to the present invention include, but are not limited to, neoplasm, malignant; Carcinoma, NOS; Carcinoma, undifferentiated, NOS; Giant and spindle cell carcinoma; Small cell carcinoma, NOS; Papillary carcinoma, NOS; Squamous cell carcinoma, NOS; Lymphoepithelial carcinoma; Basal cell carcinoma, NOS; Pilomatrix carcinoma; Transitional cell carcinoma, NOS; Papillary transitional cell carcinoma; Adenocarcinoma, NOS; Gastrinoma, malignant; Cholangiocarcinoma; Hepatocellular carcinoma, NOS; Combined hepatocellular carcinoma and cholangiocarcinoma; Trabecular adenocarcinoma; Adenoid cystic carcinoma; Adenocarcinoma in adenomatous polyp; Adenocarcinoma, familial polyposis coli; Solid carcinoma, NOS; Carcinoid tumor, malignant; Bronchioloalveolar adenocarcinoma; Papillary adenocarcinoma, NOS; Chromophobe carcinoma; Acidophil carcinoma; Oxyphilic adenocarcinoma; Basophil carcinoma; Clear cell adenocarcinoma, NOS; Granular cell carcinoma; Follicular adenocarcinoma, NOS; Papillary and follicular adenocarcinoma; Nonencapsulating sclerosing carcinoma; Adrenal cortical carcinoma; Endometroid carcinoma; Skin appendage carcinoma; Apocrine adenocarcinoma; Sebaceous adenocarcinoma; Ceruminous adenocarcinoma; Mucoepidermoid carcinoma; Cystadenocarcinoma, NOS; Papillary cystadenocarcinoma, NOS; Papillary serous cystadenocarcinoma; Mucinous cystadenocarcinoma, NOS; Mucinous adenocarcinoma; Signet ring cell carcinoma; Infiltrating duct carcinoma; Medullary carcinoma, NOS; Lobular carcinoma; Inflammatory carcinoma; Paget's disease, mammary; Acinar cell carcinoma; Adenosquamous carcinoma; Adenocarcinoma w/squamous metaplasia; Thymoma, malignant; Ovarian stromal tumor, malignant; Thecoma, malignant; Granulosa cell tumor, malignant; Androblastoma, malignant; Sertoli cell carcinoma; Leydig cell tumor, malignant; Lipid cell tumor, malignant; Paraganglioma, malignant; Extra-mammary paraganglioma, malignant; Pheochromocytoma; Glomangiosarcoma; Malignant melanoma, NOS; Amelanotic melanoma; Superficial spreading melanoma; Malig melanoma in giant pigmented nevus; Epithelioid cell melanoma; Blue nevus, malignant; Sarcoma, NOS; Fibrosarcoma, NOS; Fibrous histiocytoma, malignant; Myxosarcoma; Liposarcoma, NOS; Leiomyosarcoma, NOS; Rhabdomyosarcoma, NOS; Embryonal rhabdomyosarcoma; Alveolar rhabdomyosarcoma; Stromal sarcoma, NOS; Mixed tumor, malignant, NOS; Mullerian mixed tumor; Nephroblastoma; Hepatoblastoma; Carcinosarcoma, NOS; Mesenchymoma, malignant; Brenner tumor, malignant; Phyllodes tumor, malignant; Synovial sarcoma, NOS; Mesothelioma, malignant; Dysgerminoma; Embryonal carcinoma, NOS; Teratoma, malignant, NOS; Struma ovarii, malignant; Choriocarcinoma; Mesonephroma, malignant; Hemangiosarcoma; Hemangioendothelioma, malignant; Kaposi's sarcoma; Hemangiopericytoma, malignant; Lymphangiosarcoma; Osteosarcoma, NOS; Juxtacortical osteosarcoma; Chondrosarcoma, NOS; Chondroblastoma, malignant; Mesenchymal chondrosarcoma; Giant cell tumor of bone; Ewing's sarcoma; Odontogenic tumor, malignant; Ameloblastic odontosarcoma; Ameloblastoma, malignant; Ameloblastic fibrosarcoma; Pinealoma, malignant; Chordoma; Glioma, malignant; Ependymoma, NOS; Astrocytoma, NOS; Protoplasmic astrocytoma; Fibrillary astrocytoma; Astroblastoma; Glioblastoma, NOS; Oligodendroglioma, NOS; Oligodendroblastoma; Primitive neuroectodermal; Cerebellar sarcoma, NOS; Ganglioneuroblastoma; Neuroblastoma, NOS; Retinoblastoma, NOS; Olfactory neurogenic tumor; Meningioma, malignant; Neurofibrosarcoma; Neurilemmoma, malignant; Granular cell tumor, malignant; Malignant lymphoma, NOS; Hodgkin's disease, NOS; Hodgkin's; paragranuloma, NOS; Malignant lymphoma, small lymphocytic; Malignant lymphoma, large cell, diffuse; Malignant lymphoma, follicular, NOS; Mycosis fungoides; Other specified non-Hodgkin's lymphomas; Malignant histiocytosis; Multiple myeloma; Mast cell sarcoma; Immunoproliferative small intestinal disease; Leukemia, NOS; Lymphoid leukemia, NOS; Plasma cell leukemia; Erythroleukemia; Lymphosarcoma cell leukemia; Myeloid leukemia, NOS; Basophilic leukemia; Eosinophilic leukemia; Monocytic leukemia, NOS; Mast cell leukemia; Megakaryoblastic leukemia; Myeloid sarcoma; and Hairy cell leukemia.

"Epithelial cancers" as defined herein refers to cancer(s) that develops from epithelium or related tissues in the skin, hollow viscera, and other organs. Epithelial cancers include but are not limited to breast cancer, lung cancer, liver cancer, buccal cancer, stomach cancer, colon cancer, nasopharyngeal cancer, dermal cancer, renal cancer, brain tumor, prostate cancer, ovarian cancer, cervical cancer, endometrial cancer, intestinal cancer, pancreatic cancer, and bladder cancer.

"Patient" or "Subject" as used herein refers to a mammalian subject diagnosed with or suspected of having or developing a proliferative disease such as cancer. Exemplary patients may be humans, apes, dogs, pigs, cattle, cats, horses, goats, sheep, rodents and other mammalians that can benefit develop proliferative diseases such as cancer.

As used herein, "substantially purified" or "substantially isolated" refers to a molecule (e.g. a compound) in a state that it is separated from substantially all other molecules normally associated with it in its native state. Preferably, a substantially purified molecule is the predominant species present in a preparation. Particularly, a substantially purified molecule may be greater than 60% free, preferably 75% free, more preferably 90% free, and most preferably 95% free from the other molecules (exclusive of solvent) present in the natural mixture. The term "substantially purified" or "substantially isolated" is not intended to include molecules or substances present in their native state. In certain embodiments, the term "substantially purified" or "substantially isolated" includes purifying one KLH moiety from another KLH moiety (e.g., substantially purifying or substantially isolating a KLH dimer moiety from a KLH trimer moiety). In another embodiment, the term "substantially purified" or "substantially isolated" does not include purifying one KLH moiety from another KLH moiety (e.g, KLH dimers and KLH trimmers are included in a substantially purified or substantially isolated composition) but impurities are substantially removed.

"Administering" is referred to herein as providing a therapeutic composition of the invention to a patient. By way of example and not limitation, composition administration, e.g., injection, may be performed by intravenous (i.v.) injection, subcutaneous (s.c.) injection, intradermal (i.d.) injection, intraperitoneal (i.p.) injection, or intramuscular (i.m.) injection. One or more such routes may be employed. Parenteral administration can be, for example, by bolus injection or by gradual perfusion over time. Alternatively, or concurrently, administration may be by the oral route. Additionally, administration may also be by surgical deposition of a bolus or positioning of a medical device.

"A patient in need thereof" is referred to herein as a patient diagnosed with or suspected of having a proliferative disorder. In one embodiment, the patient has or is likely to develop cancer.

As used herein, the term "antigen" is defined as any substance capable of eliciting an immune response, with or without the help of a protein carrier and/or an adjuvant. Preferably the antigen of the inventive compositions includes a carbohydrate and more preferably glycan-antigen and most preferably a Globo H moiety.

As used herein, the term "immunogenicity" refers to the ability of an immunogen, antigen, or vaccine to stimulate an immune response.

As used herein, the term "immunotherapy" refers to an array of treatment strategies based upon the concept of modulating the immune system to achieve a prophylactic and/or therapeutic goal.

As used herein, the term "epitope" is defined as the parts of an antigen molecule which contact the antigen binding site of an antibody or a T cell receptor.

The "therapeutic compositions" of the invention preferably include "therapeutic conjugates" and/or "therapeutic antibodies." The therapeutic conjugates include at least one antigen linked to a carrier. Preferably, the linkage of the therapeutic conjugate is covalent. In one embodiment of the therapeutic conjugate, the antigen is a glycan such as Globo H moiety, and the carrier is a KLH moiety and/or a KLH moiety subunit. As such, the term therapeutic conjugate encompasses one or more KLH moiety subunits linked to one or more Globo H moieties. In one embodiment, the term therapeutic conjugate encompasses a one or more KLH moieties linked to about or at least 1, 10, $10^2$ or $10^3$ Globo H moieties. In another embodiment, the term therapeutic conjugate encompasses one or more KLH moieties linked to about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, or more Globo H moieties. Another embodiment encompasses isolated dimers, trimers, tetramers, pentamers or hexamers of such Globo H linked KLH moiety subunits, or combinations thereof.

In one embodiment, the therapeutic conjugate is: Fucα(1→2)Galβ(1→3)GalNAcβ(1→3)Galα(1→4)Galβ(1→4)Gluβ(1-O-ethylhydrazyl-1-carbonyl-cyclohexyl-4-(methyl-N-maleimido)-3-(thiobutyl-imidyl)-Keyhole Limpet Haemocyanin (KLH) also referred to as OBI-822.

"Therapeutic antibodies" are defined to be as antibodies (as further defined below) that specifically bind the inventive therapeutic conjugates and preferably the Globo H moiety portion of the therapeutic conjugates.

As used herein, the term "vaccine" refers to a therapeutic composition that contains a therapeutic conjugate that is used to confer immunity against a disease associated with the antigen. Cancer vaccines are designed to boost the body's natural ability to protect itself, through the immune system, from dangers posed by damaged or abnormal cells such as cancer cells. A protective immune response is one that reduces the severity of disease, including but not limited to, prevention of disease, delay in onset of disease, decreased severity of symptoms, decreased morbidity, and delayed mortality. Preferably, a vaccine is capable of activating both humoral immune response (e.g. stimulation of the production of antibodies by B lymphocytes) and cellular immune response (e.g. an immune response that is mediated by T-lymphocytes and/or other cells, such as NK cells and macrophages). Standard assays have been developed to determine the immune response such as enzyme-linked immunosorbent assay (ELISA), flow cytometry, cell proliferation assay, CTL assays, and ADCC/CDC assays.

As used herein, the term "glycan" refers to a polysaccharide, or oligosaccharide. Glycan is also used herein to refer to the carbohydrate portion of a glycoconjugate, such as a glycoprotein, glycolipid, glycopeptide, glycoproteome, peptidoglycan, lipopolysaccharide or a proteoglycan. Glycans usually consist solely of 0-glycosidic linkages between monosaccharides. For example, cellulose is a glycan (or more specifically a glucan) composed of β-1,4-linked D-glucose, and chitin is a glycan composed of β-1,4-linked N-acetyl-D-glucosamine. Glycans can be homo or heteropolymers of monosaccharide residues, and can be linear or branched. Glycans can be found attached to proteins as in glycoproteins and proteoglycans. They are generally found on the exterior surface of cells. O- and N-linked glycans are very common in eukaryotes but may also be found, although less commonly, in prokaryotes. N-Linked glycans are found attached to the R-group nitrogen (N) of asparagine in the sequon. The sequon is an Asn-X-Ser or Asn-X-Thr sequence, where X is any amino acid except praline. The preferred glycan is a Globo H moiety.

Globo H is a hexasaccharide, which is a member of a family of antigenic carbohydrates that are highly expressed on a various types of cancers, especially cancers of breast, prostate, pancreas, stomach, ovary, colon, and lung. In illustrative embodiments, certain patients exhibited no anti-Globo H antibody levels at time zero, and after immunization with the therapeutic composition of the invention high titers were detected. In other illustrative embodiments, certain patients exhibited anti-Globo H antibody levels at time zero, and after immunization with the therapeutic composition of the invention high titers were detected. In certain embodiments, the anti-Globo H antibody is expressed on the cancer cell surface as a glycolipid and possibly as a glycoprotein. In other embodiments, the serum of breast cancer patients contained high levels of antibodies against the Globo H epitope. In certain embodiments, this epitope is also targeted by the monoclonal antibodies Mbrl, VK9 and anti-SSEA-3 in immunohistochemistry studies. Although certain normal tissues also react with Mbrl, including normal breast, pancreas, small bowel, and prostate tissue, the antigen in these tissues is predominantly localized at the secretary borders where access to the immune system is restricted.

"Globo H moiety" is defined herein to be a glycan (i.e., a molecule containing a sugar moiety) that is Globo H or a fragment or analog thereof. Globo H is a glycan containing the hexasaccharide epitope (Fucα1→2 Galβ1→3 GalNAcβ1→3 Galα1→4 Galβ1→4 Glc), and optionally, a non-sugar moiety. Its fragment is a glycan containing a fragment of the hexasaccharide epitope and, if applicable, the non-sugar moiety. These oligosaccharides can be prepared by routine methods. (See Huang et al., Proc. Natl. Acad. Sci. USA 103:15-20 (2006)). If desired, they can be linked to a non-sugar moiety. U.S. patent application Ser. No. 12/485,546 relates to a method of producing antibody specific to Globo H or its fragment by administering to a non-human mammal (e.g., mouse, rabbit, goat, sheep, or horse) the immune composition described above and isolating from the mammalian antibody that binds to Globo H or its fragment.

Figure 1B:
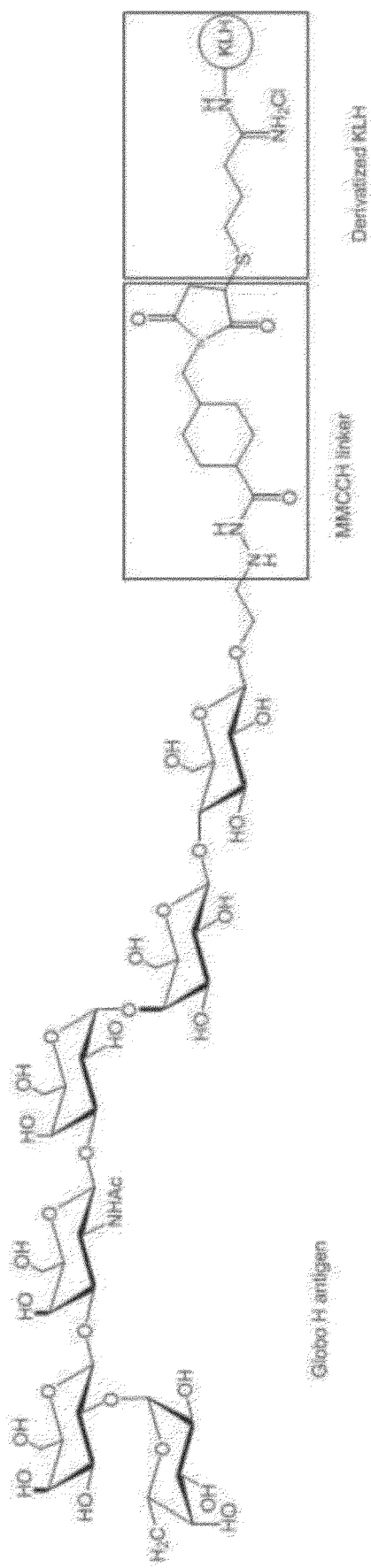
FIG. 1B shows an exemplary Globo H-KLH subunit conjugated by way of an MMCCH linker.

Analogs of Globo H can be generated using glycan microarray and include those disclosed in Wang et al., Proc Natl Acad Sci USA. 2008 Aug. 19; 105(33): 11661-11666 and shown in FIG. 1.

Globo H analogs preferably bind antibodies VK-9, Mbrl, and anti-SSEA-3. Preferably, the Globo H Analogs bind with a particular dissociation constant ($K_{D,surf}$). The Langmuir isotherm can be used for analyzing the binding curves to generate the dissociation constants on surface ($K_{D,surf}$). At the equilibrium conditions during incubation, the mean fluorescence of the replicate spots ($F_{obs}$) can be described by:

$$F_{obs}=F_{max}[P]/(K_{D,surf}+[P])$$

where $F_{max}$ is the maximum fluorescence intensity, a measure of the amount of active carbohydrate on the surface, [P] is the total antibody concentration, and $K_{D,surf}$ is the equilibrium dissociation constant for surface carbohydrate and the antibody. As described in Wang et al. In some embodiments the preferred ($K_{D,surf}$) of Globo H analogs is at least, about or exactly 0.4, 0.5., 0.6, 0.7, 0.8, 0.9, 1.0, 1.1, 1.2, 1.3, 1.4, 1.5 or 1.6 nM with respect to the VK-9, Mbr1, and anti-SSEA-3 antibodies described in Wang et al.

"Keyhole Limpet Hemocyanin" (KLH) is a large, multi-subunit, oxygen-carrying, metalloprotein found in the hemolymph of the giant keyhole limpet, *Megathura crenulata*. KLH is heterogeneous glycosylated protein consisting of subunits with a molecular weight of about 350,000 to about 390,000 in aggregates with molecular weights of about 400 kDA (e.g., a KLH monomer) to about 8000 kDA (e.g., a KLH didecamer). Each domain of a KLH subunit contains two copper atoms that together bind a single oxygen molecule. When oxygen is bound to hemocyanin, the molecule takes on a distinctive transparent, opalescent blue color. In certain embodiments, the KLH protein is potently immunogenic yet safe in humans. In certain embodiments, KLH may be purified from the hemolymph of *Megathura crenulata* by a series of steps that typically includes ammonium sulfate precipitation and dialysis, and may involve chromatographic purification to obtain the highest purity. In certain embodiments, KLH purification may also include endotoxin removal, but this step may be unnecessary because the endotoxin can serve as an adjuvant when injected for antibody production. Preferably, a high quality KLH preparation with the clear opalescent blue color is the best indicator of KLH solubility. In certain embodiments, the KLH monomeric units assemble into a large multimer (decamer or didecamer) with a total molecular weight of about 4,000 kDa to 8,000 kDa. "Keyhole Limpet Hemocyanin moiety" or "KLH moiety" is defined herein to be a KLH1 (SEQ ID NO: 1) or KLH2 (SEQ ID NOT: 2) protein or a protein substantially identical thereto or a mixture thereof. Substantially identical in this context means each KLH moiety has an amino sequence at least, about or exactly: 100, 99, 98, 97, 96, 95, 94, 93, 92, 91, 90, 89, 88, 87, 86, 85, 84, 83, 82, 81, 80, 79, 78, 77, 76 or 75 percent identical to that of native wild type KLH. In certain embodiments, the KLH of the invention has enhanced immunogenic activity, particularly enhanced antitumor activity. In certain embodiments, the KLH in the composition of the present invention comprises an intact, non-degraded subunit of approximately 400,000 in molecular weight. In other embodiments, the KLH of the invention comprises higher KLH multimers.

In certain embodiments, the higher KLH multimers have molecular weights of approximately 8-10 million with sedimentation coefficients of about 92-107S. The amount of higher KLH multimers present is based on sedimentation-equilibrium and/or sedimentation-velocity ultracentrifugation analyses. In other embodiments, the KLH of the invention demonstrates an enhanced immunogenic activity, particularly enhanced anti-tumor activity. The enhanced immunogenic activity is seen for example, but not limited, (a) with injection of KLH (without adjuvant), (b) with KLH used as an adjuvant, (c) with KLH used as a carrier immunogen for haptens or weakly immunogenic antigens, and (d) with KLH used as an anti-tumor agent. The KLH composition of the invention exhibits enhanced anti-tumor activity for many tumors, including, but not limited to, bladder, breast, ovarian tumors, etc. In certain embodiments, two KLH moieties can form a dimer via a covalent linkage between KLH monomers. Without being limited by theory, it is believed that the covalent linkage between KLH moieties is through a disulfide bond. In certain embodiments, two or more KLH moieties can form a dimer, trimer, tetramer, pentamer, etc. via a covalent linkage between KLH monomers, dimers, trimers, etc. Without being limited by theory, it is believed that the covalent linkage between KLH moieties is through a disulfide bond.

There are a variety of methods for linking of a KLH moiety to an antigen, including direct conjugation and conjugation with a bifunctional linker group such as 4-(4-N-maleimidomethyl) cyclohexane-1-carboxyl hydrazide (MMCCH). Such linkage techniques are disclosed in U.S. Pat. No. 6,544,952. In some embodiments, to prepare the therapeutic conjugates of the invention, for example, the Globo H allyl glycoside is converted to an aldehyde by ozonolysis and the aldehyde group is attached to the NH groups on the crosslinker MMCCH, giving Globo H-MMCCH; the carrier protein, KLH, is subjected to thiolation to produce KLH-SH; and the sulfhydryl groups on thiolated KLH are then attached to the maleimide group on the MMCCH, producing Globo H-KLH conjugates.

Figure 2A:
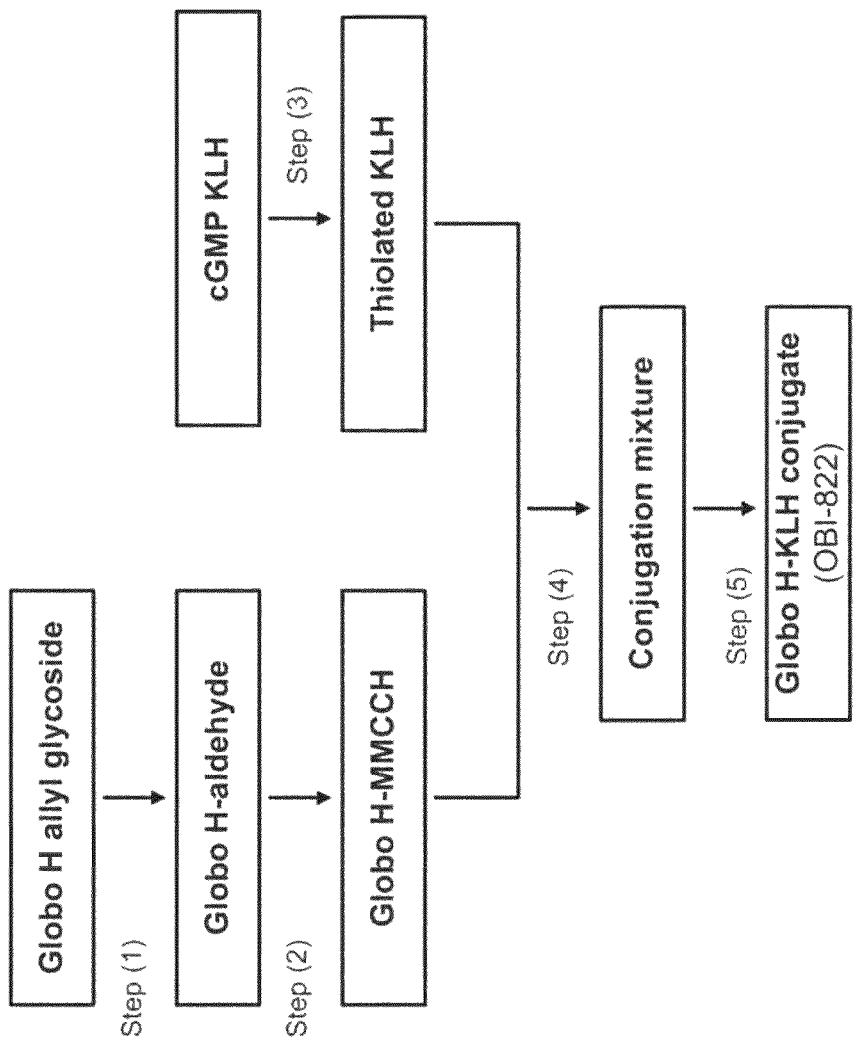
FIG. 2A shows an exemplary Globo H-KLH subunit conjugation synthesis pathway.

In one embodiment, Globo H allyl glycoside is prepared via chemical synthesis. A thiolating reagent, 2-iminothiolane and cGMP-grade KLH and 4-(4-N-maleimidomethyl)-cyclohexane-1-carboxyl hydrazide (MMCCH) linker are also used. In some embodiments the following steps are carried out: 1) Conversion of Globo H allyl glycoside to the Globo H-aldehyde; 2) Coupling of Globo H-aldehyde with MMCCH to Globo H-MMCCH, separately; 3) Chemical thiolation of KLH; 4) Conjugation of Globo H-MMCCH to the thiolated KLH; and 5) Purification of the Globo H-KLH conjugate (OBI-822). See for example FIG. 2a.

In certain embodiments, during conjugation of a Globo H moiety protein to a KLH moiety, a KLH moiety protein in certain embodiments shows a reduction in molecular weight compared to the intact molecule preferably due to Globo H moiety subunit dissociation. In other embodiments, the conjugation methods disclosed herein result in a KLH subunit dissociation not previously reported. While not wishing to be bound to any particular theory, it is envisaged that the high glycosylation level of the inventive Globo H moiety-KLH moiety subunit conjugates results in the formation hydrogen bonding between the Globo H moieties. As such, in certain embodiments, the Van Der Waals forces and hydrophobic interactions between the KLH moiety subunits are displaced by Globo H hydrogen bonding and this leads to KLH moiety subunit separation. Following conjugation, the KLH moiety subunits of a Globo H moiety-KLH moiety conjugate preferably aggregate to form novel monomers, dimers, trimers, tetramers, pentamers or hexamers or any combination thereof. The resulting therapeutic Globo H moiety-KLH moiety conjugates have an unexpectedly large epitope ratio resulting in unexpectedly superior immunogenic attributes. In certain embodiments, the Globo H moieties are conjugated to Lysines on KLH1 and KLH2. In other embodiments, the Globo H moieties are not conjugated to Lysines on KLH1 and KLH2. In certain embodiments, the Globo H-conjugated lysine sites are found conserved in the peptide mapping analysis suggesting the Globo H-KLH composition is unique in its structure.

In one embodiment, therapeutic compositions of the invention include one or more KLH moiety subunits wherein at least one such subunit is conjugated to at least, about or exactly 1, 10, $10^2$ or $10^3$ times: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159 or 160 or more Globo H moieties.

The inventors found using mass spectrometric analysis that the Globo H moieties are conjugated to lysine residues of KLH. In certain embodiments, it is therefore preferred that the Globo H moieties are conjugated to lysine residues.

In one embodiment, there are total of exactly or about 145, 146, 147, 148, 149, 150, 151, 152, 153, 154, 155, 156, 157, 158, 159, 160 total lysine residues per KLH moiety subunit. In another embodiment there are exactly or about 150 or 156 lysine residues per KLH moiety subunit. In another embodiment, there are exactly or about 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109 or 110 lysine conjugation sites on each KLH moiety subunit available for binding to or actually bound to a Globo H moiety. In another embodiment, there are 62, 66, 67, 68, 70, 72, 76, 86, 87, 88, 90, 92, 93, 100 such lysine conjugation sites on each KLH moiety subunit. Lysine conjugation sites are those lysine residues in the KLH moiety which are available for binding or actually bind to a Globo H moiety and/or a linker to a Globo H moiety such as for example an MMCCH linker.

In certain therapeutic embodiments containing a mixture of moiety subunits (e.g., KLH1 and KLH2 or variants thereof), total available lysine (for both subunits) as are counted together across the different subunit types the and may be or are exactly about 290, 291, 292, 293, 294, 295, 296, 297, 298, 299, 300, 301, 302, 303, 304, 305, 306, 307, 308, 309 or 310 in number. In such embodiments, there are or may be exactly or about 130, 131, 132, 133, 134, 135, 136, 137, 138, 139, 140, 141, 142, 143, 144, 145, 146, 147, 148, 149, 150, 151, 152, 153, 154, 155, 156, 157, 158, 159 or 160 lysine conjugation sites together across the different subunits (e.g., KLH1 and KLH2 or variants thereof). In other such embodiments, there are 136, 137, 141, 140, 143, 147 or 155 lysine conjugation sites.

Ina most preferred embodiment there are 136, 137, 140, 141, 143, 147 or 155 and lysine conjugation sites among the total 306 lysine residues in KLH1/KLH2.

In certain embodiments, the therapeutic compositions of the invention contain a mixture of KLH moiety subunit-Globo H moiety conjugates wherein such conjugates remain monomers or form dimers, trimers, tetramers, pentamers or hexamers or any combination thereof. In another embodiment, the therapeutic compositions of the invention include isolated KLH moiety subunit-Globo H moiety conjugate monomers, dimers, trimers or tetramers or combinations of thereof. In a further embodiment, the therapeutic compositions of the invention include only KLH moiety subunit-Globo H moiety conjugate dimers and trimers.

In another embodiment, the therapeutic compositions contain at least two KLH moiety subunits wherein each of the two KLH-moiety subunits is linked to different glycans. Other tumor-associated glycan antigens linkable to KLH moiety subunits can include but are not limited to GM2, GD2, GD3, fucosyl, GM1, sTn, sialyl-Lewis$^x$, Lewis$^x$, sialyl Lewis$^a$, Lewis$^a$, sTn, TF, polysialic acid, Lewis$^y$, mucins, T antigen, and the like. In some embodiments only, at least or about 10, 20, 30, 40, 50, 60, 70, 80, 90 or 100 percent of the KLH moiety subunits in a therapeutic composition are linked to a Globo H moiety whereas the remaining KLH moiety subunits in the therapeutic composition are linked to other tumor-associated glycan antigens.

As used herein, "epitope ratio" relating to the therapeutic conjugates disclosed herein refers to for example, the relationship of antigen epitopes to carrier molecules in a therapeutic conjugate. Preferably, it refers to the relationship of Globo H moieties to KLH moieties. Most preferably the epitope ratio of a therapeutic conjugate is calculated using the following formula=(actual Globo H moiety weight/Globo H moiety molecular weight)/(actual KLH moiety weight/KLH moiety molecular weight). Epitope ratios are readily determinable by those of skill in the art. Preferably, the weights of Globo H are determined for example by high performance anion exchange chromatography with pulsed amperometric detection (HPAEC-PAD).

Preferably, the epitope ratios of the therapeutic conjugates of the invention are about, at least or exactly: 1, 10, 25, 50, 75, 100, 125, 150, 175, 200, 225, 250, 275, 300, 325, 350, 375, 400, 425, 450, 475, 500, 525, 575, 600, 625, 650, 675, 700, 725, 750, 775, 800, 825, 850, 875, 900, 925, 950, 975, 1000, 1025, 1050, 1075, 1100, 1125, 1150, 1175, 1200, 1225, 1250, 1275, 1300, 1325, 1350, 1375, 1400, 1425, 1450, 1475, 1500, 1525, 1550, 1575, 1600, 1625, 1650, 1675, 1700, 1725, 1750, 1775, 1800, 1825, 1850, 1875, 1900, 1925, 1950, 1975, 2000, 2025, 2050, 2075, 2100, 2125, 2150, 2175, 2200, 2225, 2250, 2275, 2300, 2325, 2350, 2375, 2400, 2425, 2450, 2475, 2500, 2525, 2550, 2575, 2600, 2625, 2650, 2675, 2700, 2725, 2750, 2775, 2800, 2825, 2850, 2875, 2900, 2925, 2950, 2975 or 3000.

In one embodiment, the therapeutic compositions of the invention include a mixture of therapeutic conjugates having a range of epitope ratios. In one embodiment, the range, the mean or the median epitope ratios of the therapeutic conjugates in the therapeutic composition is about 10 to about 3200, about 800 to about 2500, about 1000 to about 2000, about 1250 to about 1750 or about 1400 to about 1600. In another embodiment, the range, the mean or the median epitope ratios of the therapeutic conjugates in the therapeutic composition is about 10 to about 150, about 40 to about 125, about 50 to about 100, about 62 to about 87 or about 70 to about 80. In another embodiment, the range, the mean or the median epitope ratios of the therapeutic conjugates in the therapeutic composition is about 20 to about 300, about 80 to about 250, about 100 to about 200, about 125 to about 175 or about 140 to about 160. In another embodiment, the range, the mean or the median epitope ratios of the therapeutic conjugates in the therapeutic composition is about 30 to about 450, about 120 to about 375, about 150 to about 300, about 185 to about 260 or about 210 to about 240. In some the pharmaceutical compositions at least or about 30, 40, 50, 60, 70, 80, 90, 95, 98, 99, or 100% of the therapeutic conjugates exist as monomers, or as dimers, trimers, tetramers, pentamers, or combinations thereof.

Antibodies to Therapeutic Conjugates

In certain illustrative embodiments, the invention also encompasses isolated therapeutic antibodies, which specifically bind the therapeutic conjugates disclosed herein with affinity, as well as their use in the treatment and/or diagnosis of proliferative disease.

As used herein, the terms "antibody" and "antibodies" (immunoglobulins) encompass monoclonal antibodies (including full-length monoclonal antibodies), polyclonal antibodies, multispecific antibodies (e.g., bispecific antibodies) formed from at least two intact antibodies, human antibodies, humanized antibodies, camelised antibodies, chimeric antibodies, single-chain Fvs (scFv), single-chain antibodies, single domain antibodies, domain antibodies, Fab fragments, F(ab')2 fragments, antibody fragments that exhibit the desired biological activity, disulfide-linked Fvs (sdFv), and anti-idiotypic (anti-Id) antibodies (including, e.g., anti-Id antibodies to antibodies of the invention), intrabodies, and epitope-binding fragments of any of the above. In particular, antibodies include immunoglobulin molecules and immunologically active fragments of immunoglobulin molecules, i.e., molecules that contain an antigen-binding site Immunoglobulin molecules can be of any type (e.g., IgG, IgE, IgM, IgD, IgA and IgY), class (e.g., IgG1, IgG2, IgG3, IgG4, IgA1 and IgA2) or subclass.

"Affinity" of an antibody for an epitope, e.g., the Globo H moiety of a therapeutic conjugate, to be used in the treatment(s) described herein is a term well understood in the art and means the extent, or strength, of binding of antibody to epitope. Affinity may be measured and/or expressed in a number of ways known in the art, including, but not limited to, equilibrium dissociation constant (KD or Kd), apparent equilibrium dissociation constant (KD' or Kd'), and IC50 (amount needed to effect 50% inhibition in a competition assay). It is understood that, for purposes of this invention, an affinity is an average affinity for a given population of antibodies which bind to an epitope. Values of KD' reported herein in terms of mg IgG per mL or mg/mL indicates mg Ig per mL of serum, although plasma can be used. When antibody affinity is used as a basis for administration of the treatment methods described herein, or selection for the treatment methods described herein, antibody affinity can be measured before and/or during treatment, and the values obtained can be used by a clinician in assessing whether a human patient is an appropriate candidate for treatment.

As used herein, the term "specifically binding," refers to the interaction between binding pairs (e.g., an antibody and an antigen). In various instances, specifically binding can be embodied by an affinity constant of at least or about 10-6 moles/liter, about 10-7 moles/liter, or about 10-8 moles/liter, or less.

Biological Assays

In one embodiment, when administered to a patient, the therapeutic compositions containing therapeutic conjugates of the invention are able to induce anti-Globo H antibody titers at least or about 1, 2, 3, 4, 5, 6, 7, 8, 9, 10, 11, 12, 13, 14, 15, 16, 17, 18, 19, 20, 50, 100, 250, 500, 1000, 1500, 2000, 2500, 3000, 4000, or 5000 fold greater that the same anti-Globo H antibody titer prior to the administration (i.e., a pre-treatment baseline titer) in the same experiment. In certain embodiments the anti-Globo H antibodies are IgM antibodies. In another embodiment, the anti-Globo H antibodies are IgG antibodies.

The therapeutic compositions of the invention are capable of inducing both humoral and cellular responses in a subject. In certain embodiments, the vaccine composition of the invention induces production of Globo H moiety-specific IgG and IgM antibodies and expansion of B cells and T cells (e.g. $CD3^+$ T cells, $CD4^+$ T cells and/or $CD8^+$ T cells). Typically, these immune responses occur chronologically after administration. In a particular example, after administration, the B cell production appears at about day 3, 4, 5, 6, 7, 8, 9, 10, 20, 30, or 60 days, followed by production of IgG and IgM antibodies at about day 10, 20, 30, 60, or 90 and subsequent T cell production at about day 24, 30, 40, 50, 60, 90, 120, 150, or 180. The vaccine composition of the invention potentially provides a long term immunological protective effect which could prevent the growth of small quantities of cancer cells, thereby being ideal for minimal residual disease so as to achieve disease stabilization and survival improvement.

"Antibody-dependent cell-mediated cytotoxicity" and "ADCC" refer to a cell-mediated reaction in which non-specific cytotoxic cells (e.g., Natural Killer (NK) cells, neutrophils, and macrophages) recognize bound antibody on a target cell and subsequently cause lysis of the target cell. In one embodiment, such cells are human cells. While not wishing to be limited to any particular mechanism of action, these cytotoxic cells that mediate ADCC generally express Fc receptors (FcRs). The primary cells for mediating ADCC, NK cells, express FcγRIII, whereas monocytes express FcγRI, FcγRII, FcγRIII and/or FcγRIV. FcR expression on hematopoietic cells is summarized in Ravetch and Kinet, Annu Rev. Immunol., 9:457-92 (1991). To assess ADCC activity of a molecule, an in vitro ADCC assay, such as that described in U.S. Pat. No. 5,500,362 or 5,821,337 may be performed. Useful effector cells for such assays include peripheral blood mononuclear cells (PBMC) and Natural Killer (NK) cells. Alternatively, or additionally, ADCC activity of the therapeutic conjugates of the invention may be assessed in vivo, e.g., in an animal model such as that disclosed in Clynes et al., Proc. Natl. Acad. Sci. (USA), 95:652-656 (1998).

"Complement dependent cytotoxicity" or "CDC" refers to the ability of a therapeutic conjugate to initiate complement activation and lyse a target in the presence of complement. The complement activation pathway is initiated by the binding of the first component of the complement system (Clq) to a molecule (e.g., an antibody) complexed with a cognate antigen. To assess complement activation, a CDC assay, e.g., as described in Gazzano-Santaro et al., J. Immunol. Methods, 202:163 (1996), may be performed.

In another embodiment, when administered to a patient the therapeutic compositions containing therapeutic conjugates of the invention are able to induce the production in a patient/subject of anti-Globo H immune sera, which specifically binds to Globo H positive cancer cell lines, for example, MCF-7 cells.

Combinations

Therapeutic compositions can include other anti-cancer/anti-proliferative drugs as well as adjuvants and other immunomodulatory molecules such as cytokines or chemokines. These agents may all be delivered in a kit together in separate containers or a single container. The agents may be combined at the time of administration or at least or about 1, 2, 3, 4, 5, 6, 7, 8, 9, 10, 11, 12, 13, 14, 15, 16, 17, 18, 19, 20, 21, 22, 23 or 24 minutes, hours or days prior to administration.

Adjuvants are pharmacological or immunological agents that modify the effects of other agents. They can be an inorganic or organic chemical, macromolecule or whole cancer cells or portions thereof which enhance the immune response to given antigen. Adjuvants include complete and incomplete Freund's adjuvant, Toll-Like Receptor molecules and mimetics thereof, LPS, lipoproteins, lipopeptides, flagellin, double-stranded RNA, unmethylated CpG islands, levamisole, bacillus Calmette-Guerin, octreotide, isoprinosine and Zadaxin, various forms of DNA and RNA classically released by bacteria and viruses, PD-1 antagonists and CTLA antagonists. In one embodiment, the adjuvant is a saponin adjuvant.

In certain embodiment, the saponin adjuvant is OBI-821 saponin, which is substantially pure. In other embodiments, the OBI-821 saponin is a biologically active fragments thereof. The adjuvant may also encompass impure forms of OBI-821 saponins. The purified OBI-821 saponins exhibit enhanced adjuvant effect when administered with a vaccine described herein or admixed with other substantially pure saponin or non-saponin adjuvants.

OBI-821 saponins are naturally occurring glycosides, extracted in high purify from the bark of the *Quillaja saponaria* Molina tree, by high pressure liquid chromatography (HPLC), low pressure liquid silica chromatography, and hydrophilic interactive chromatography (HILIC) as described in, for example, U.S. Pat. Nos. 5,057,540 and 6,524,584, the content of which is incorporate by reference in its entirety. High-pressure liquid chromatography analysis shows that OBI-821 are a mixture of structurally related isomeric compounds. Different purified isomeric compounds of OBI-821 saponins have been identified and disclosed herein.

In certain embodiments, OBI-821 saponin comprise at least one isolated compound of formula I as follows:

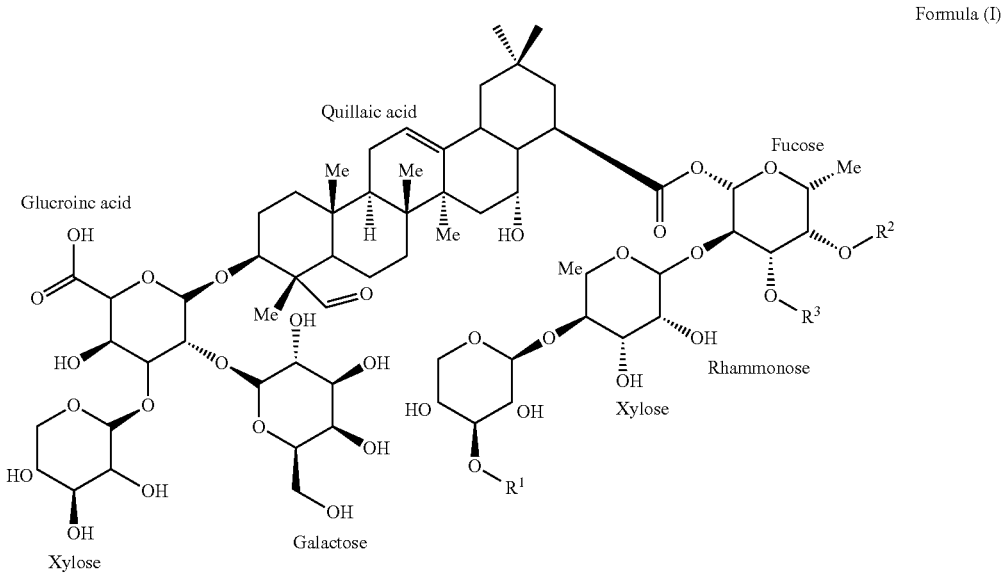

Formula (I)

wherein
R$^1$ is β-D-Apiose or β-D-Xylose; and
R$^2$ and R$^3$ are independently H, alkyl,

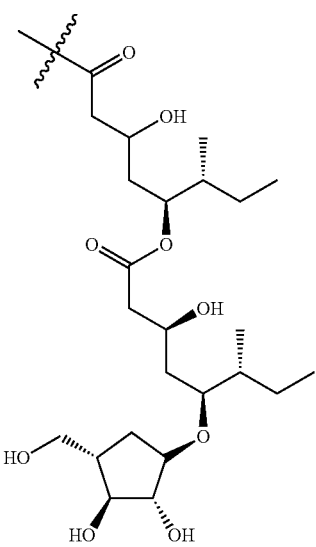

(fatty acyl moiety for Compound 1989), or

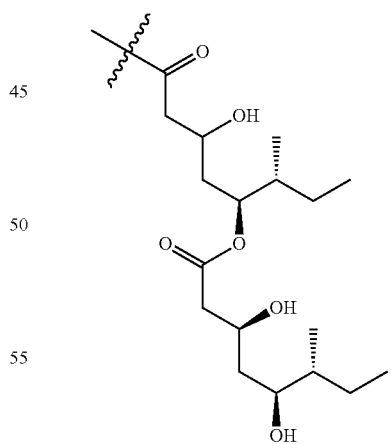

(fatty acyl moiety for Compound 1857).

OBI-821 saponin can also comprise an isolated compound of formula I, wherein (i) R$^1$ is β-D-Apiose, R$^2$ is the fatty acyl moiety for the 1989 compound depicted above, and R$^3$ is H (1989 compound VIA);

(ii) $R^1$ is β-D-Apiose, $R^2$ is H, and $R^3$ is the fatty acyl moiety fatty acyl moiety for the 1989 compound depicted above (1989 compound V1B);

(iii) $R^1$ is β-D-Xylose, $R^2$ is the fatty acyl moiety fatty acyl moiety for the 1989 compound depicted above, and $R^3$ is H (1989 compound V2A); or (iv) $R^1$ is β-D-Xylose, $R^2$ is H, and $R^3$ is the fatty acyl moiety fatty acyl moiety for the 1989 compound depicted above (1989 compound V2B). Collectively, 1989 compound V1A, 1989 compound V1B, 1989 compound V2A and 1989 compound V2B are called "1989 compounds mixture."

Table 1 summarizes the functional groups of 1989 compounds and the mole % of each 1857 compound in the 1857 compounds mixture.

TABLE 1

| Mole % | $R^1$ | $R^2$ | $R^3$ |
|---|---|---|---|
| 1989 Compound V1A 64.5% | β-D-Apiose 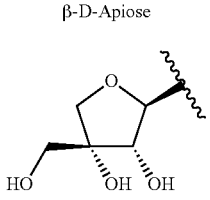 [SMILES: *[C@@H]1OC[C@](O)(CO)[C@H]1O] | 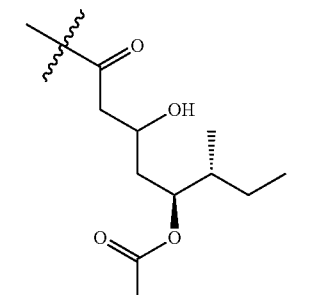 | H |
| 1989 Compound V1B 1.5% | β-D-Apiose 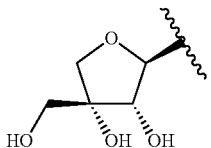 | H | 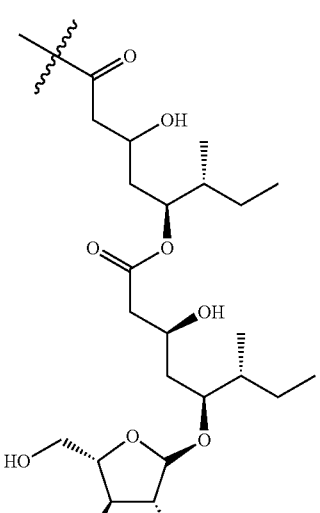 |

TABLE 1-continued

| Mole % | R¹ | R² | R³ |
|---|---|---|---|
| 1989 Compound V2A 33.3% | β-D-Xylose 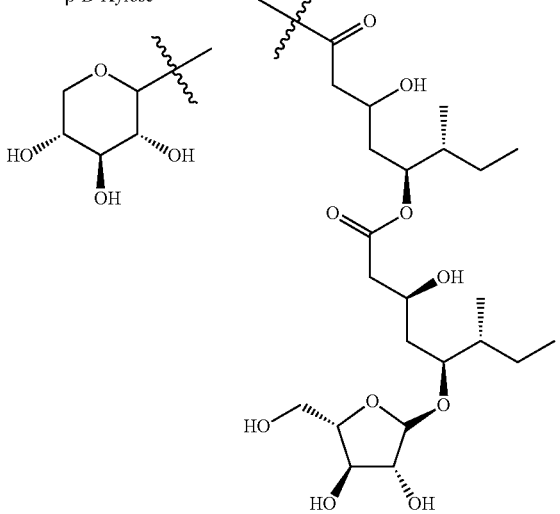 | 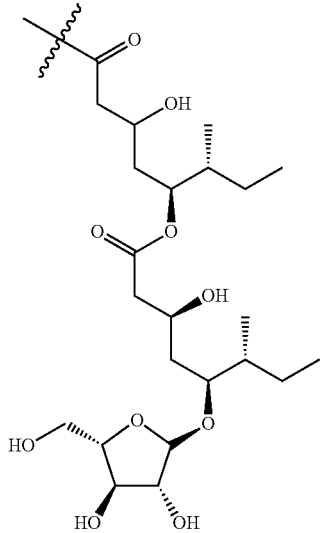 | H |
| 1989 Compound V2B 0.7% | β-D-Xylose | H | (fatty acyl moiety as depicted) |

OBI-821 saponin can comprise an isolated compound of formula I where:
(i) R¹ is β-D-Apiose, R² is the fatty acyl moiety for the 1857 compound depicted above, and R³ is H (1857 compound V1A);
(ii) R¹ is β-D-Apiose, R² is H, and R³ is the fatty acyl moiety for the 1857 compound depicted above (1857 compound V1B);
(iii) R¹ is β-D-Xylose, R² is the fatty acyl moiety for the 1857 compound depicted above, and R³ is H (1857 compound V2A); or
(iv) R¹ is β-D-Xylose, R² is H, and R³ is the fatty acyl moiety for the 1857 compound depicted above (1857 compound V2B). Collectively, 1857 compound V1A, 1857 compound V1B, 1857 compound V2A and 1857 compound V2B are called "1857 compounds mixture."

Table 2 summarizes the functional groups of 1857 compounds and the mole % of each 1857 compound in the 1857 compounds mixture. HPLC.

TABLE 2

| Mole % | R¹ | R² | R³ |
|---|---|---|---|
| 1857 Compound V1A 64.7% | β-D-Apiose | | H |
| 1857 Compound V1B 1.3% | β-D-Apiose | H | |

TABLE 2-continued

| Mole % | R¹ | R² | R³ |
|---|---|---|---|
| 1857 Compound V2A 33.4% | β-D-Xylose 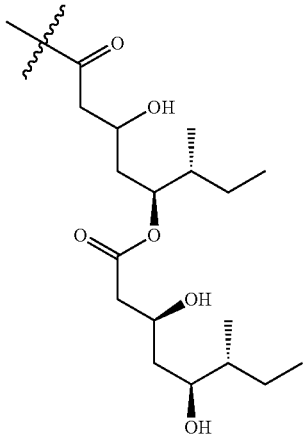 [SMILES: *C(=O)CC(O)C[C@H](OC(=O)C[C@@H](O)C[C@H](O)[C@H](C)CC)[C@H](C)CC] | 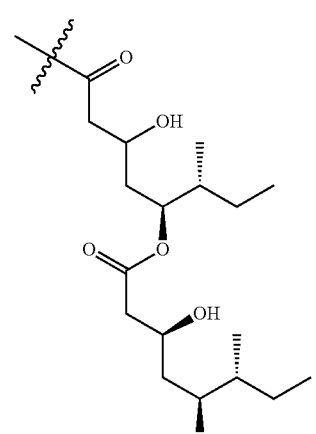 | H |
| 1857 Compound V2B 0.6% | β-D-Xylose | H | |

OBI-821 saponin comprises one or more of the following compounds:
(i) 1857 compound V1A; (ii) 1857 compound V1B;
(ii) 1857 compound V2A;
(iii) 1857 compound V2B;
(iv) 1989 compound VIA;
(v) 1989 compound V1B;
(vi) 1989 compound V2A; or
(vii) 1989 compound V2B.

The percentages of the 1857 compounds mixture and the 1989 compound mixture in OBI-821 saponin can range as follows:
(i) about 1 mole % to about 15 mole % of OBI-821 comprising an 1857 compounds mixture; and
(ii) about 85 mole % to about 99 mole % of OBI-821 comprising an 1989 compounds mixture.

All of the mole % can be varied by 0.1% increment (e.g. about 87% to about 90%, about 90.5% to about 97%, about 3.5% to about 11%, about 10% to about 14%).

The 1989 compounds mixture may comprise about 60-70 mole % of 1989 compound V1A; about 1-5 mole % of 1989 compound V1B; about 30-40 mole % of 1989 compound V2A; and about 0.1-3 mole % of 1989 compound V2B. All of the mole % can be varied by 0.1 increment (e.g. 65%, 2.5%, 35.6%).

The 1857 compounds mixture may comprise about 60-70 mole % of 1857 compound V1A; about 1-5 mole % of 1857 compound V1B; about 30-40 mole % of 1857 compound V2A; and, about 0.1-3 mole % of 1857 compound V2B. All of the mole % can be varied by 0.1 increment (e.g., 65%, 2.5%, 35.6%).

In another embodiment, the substantially pure OBI-821 is purified from a crude *Quillaja saponaria* extract, wherein said OBI-821 is characterized by a single predominant peak which comprises 90% or more of the total area of all peaks of a chromatogram, excluding the solvent peak, when analyzed on reverse phase-HPLC on a Symmetry C18 column having 5 um particle size, 100 Å pore, 4.6 mm IDx25 cm L with a elution program comprising mobile phase of A:B 95%:5% to 75%:25% in 11 minutes, which mobile phase A is distilled water with 0.1% trifluoroacetic acid, and mobile phase B is acetonitrile with 0.1% trifluoroacetic acid at a flow rate of 1 ml/min.

In one embodiment, the pharmaceutical composition comprises the compound of formula (I)

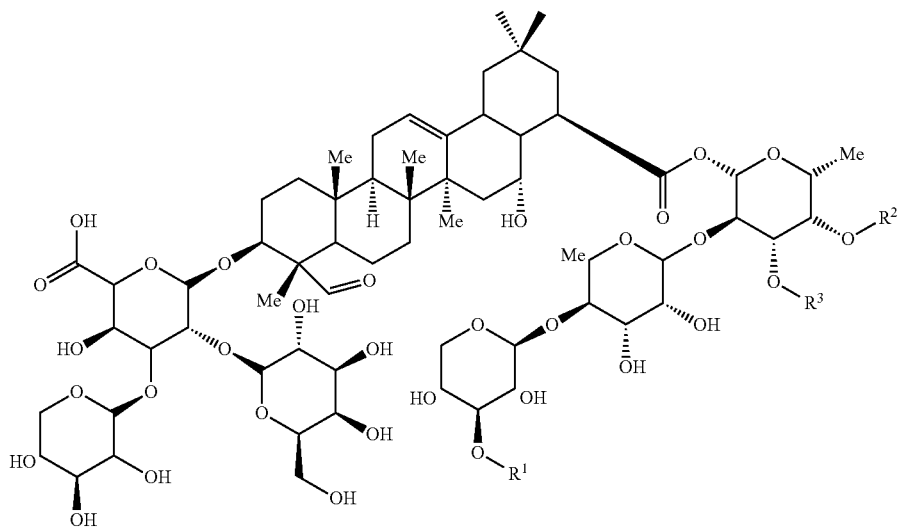

Formula (I)

wherein,
R¹ is β-D-Apiose or β-D-Xylose; and
R² and R³ are independently H, alkyl, or

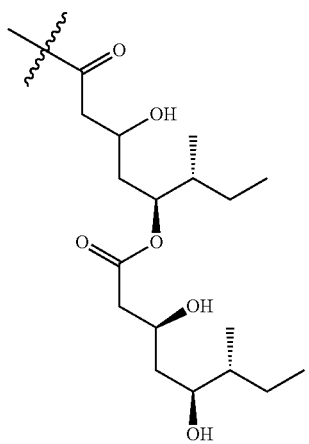 [SMILES: *C(=O)CC(O)C[C@H](OC(=O)C[C@@H](O)C[C@H](O)[C@H](C)CC)[C@H](C)CC]

(Fatty acyl moiety for the 1857 Compound),
and a pharmaceutically acceptable carrier.

The vaccine can comprise a carbohydrate antigen or its immunogenic fragment and an OBI-821 saponin. In yet another embodiment, the vaccine comprises a carbohydrate antigen or its immunogenic fragment; a carrier protein and an OBI-821 saponin. In another embodiment, the vaccine comprises a carbohydrate antigen selected from Globo H, KLH, and an OBI-821 saponin. Non limiting examples of carrier protein include KLH.

As used herein, the term "cytokine" refers to any of numerous small, secreted proteins that regulate the intensity and duration of the immune response by affecting immune cells differentiation process usually involving changes in gene expression by which a precursor cell becomes a distinct specialized cell type. Cytokines have been variously named as lymphokines, interleukins, and chemokines, based on their presumed function, cell of secretion, or target of action. For example, some common interleukins include, but are not limited to, IL-2, IL-12, IL-18, IL-2, IFN-γ, TNF, IL-4, IL-10, IL-13, IL-21, GM-CSF, and TGF-β.

As used herein, the term "chemokine" refers to any of various small chemotactic cytokines released at the site of infection that provide a means for mobilization and activation of lymphocytes. Chemokines attract leukocytes to infection sites. Chemokines have conserved cysteine residues that allow them to be assigned to four groups. The groups, with representative chemokines, are C-C chemokines (RANTES, MCP-1, MIP-1α, and MIP-1β, C-X-C chemokines (IL-8), C chemokines (Lymphotactin), and CXXXC chemokines (Fractalkine).

The therapeutic compositions of the invention can further include PD-1/PD-L1 inhibitors (cytotoxic T cell lymphocyte (CTLs) immunotherapy), CTLA-4 immunotherapy, CDK4/6 inhibitors (target therapy), PI3K inhibitors (target therapy), mTOR inhibitors (target therapy), AKT inhibitors (target therapy), Pan-Her inhibitors (target therapy). These inhibitors can be modified to generate the respective monoclonal antibody as well. Such antibodies can be included in therapeutic compositions of the invention.

The therapeutic compositions can include other anti-cancer/anti-proliferative or chemotherapeutic agents. In some embodiments, examples of such agents are found in Cancer Principles and Practice of Oncology by V. T. Devita and S. Hellman (editors), 6th edition (Feb. 15, 2001), Lippincott Williams & Wilkins Publishers. Such anti-cancer agents include, but are not limited to, the following: hormonal therapeutic agents (e.g., selective estrogen receptor modulators, androgen receptor modulators), monoclonal antibody therapy, chemotherapy, retinoid receptor modulators, cytotoxic/cytostatic agents, antineoplastic agents, antiproliferative agents, prenyl-protein transferase inhibitors, HMG-CoA reductase inhibitors, nitrogen mustards, nitroso ureas, angiogenesis inhibitors (e.g., bevacizumab), inhibitors of cell proliferation and survival signaling pathway, apoptosis inducing agents, agents that interfere with cell cycle checkpoints, agents that interfere with receptor tyrosine kinases (RTKs), mammalian target of rapamycin (mTOR) inhibitors, human epidermal growth factor receptor 2 (HER2) inhibitors, epidermal growth factor receptor (EGFR) inhibitors, integrin blockers, NSAIDs, PPAR agonists, inhibitors of inherent multidrug resistance (MDR), anti-emetic agents, agents useful in the treatment of anemia, agents useful in the treatment of neutropenia, immunologic-enhancing drugs, biphosphonates, aromatase inhibitors, agents inducing terminal differentiation of neoplastic cells, γ-secretase inhibitors, cancer vaccines, and any combination thereof.

Formulations of the Invention

The therapeutic compositions (also referred to herein as pharmaceutical compositions) generally include a pharmaceutically acceptable carrier. As used herein the language "pharmaceutically acceptable carrier" includes solvents, dispersion media, coatings, antibacterial and antifungal agents, isotonic and absorption delaying agents, and the like, compatible with pharmaceutical administration. Supplementary active compounds can also be incorporated into the compositions. A pharmaceutical composition is formulated to be compatible with its intended route of administration. Examples of routes of administration include parenteral, e.g., intravenous, intradermal, subcutaneous, intramuscular, intra-arterial, oral (e.g., inhalation), transdermal (topical), transmucosal, and rectal administration. Solutions or suspensions used for parenteral, intradermal, or subcutaneous application can include the following components: a sterile diluent such as water for injection, saline solution, phosphate buffered saline, tris-buffered saline, fixed oils, polyethylene glycols, glycerine, propylene glycol, or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates, or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes, or multiple dose vials made of glass or plastic.

Pharmaceutical compositions suitable for an injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL® (BASF, Parsippany, N.J.), or phosphate buffered saline (PBS). In all cases, the composition should be sterile and should be fluid to the extent that easy syringability exists. It should be stable under the conditions of manufacture and storage and be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, or sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, methods of preparation include vacuum drying and freeze-drying, which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be transmucosal or transdermal. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration may be accomplished through the use of nasal sprays or suppositories. For transdermal administration, the active compounds are formulated into ointments, salves, gels, or creams as generally known in the art. The compounds can also be prepared in the form of suppositories (e.g., with conventional suppository bases such as cocoa butter and other glycerides) or retention enemas for rectal delivery.

According to implementations, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially. Liposomal suspensions (including liposomes targeted to infected cells with monoclonal antibodies to cell-specific antigens) can also be used as pharmaceutically acceptable carriers. These can be prepared according to methods known to those skilled in the art, for example, as described in U.S. Pat. No. 4,522,811, which is incorporated by reference herein.

It is advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier.

Dosage Forms

Toxicity and therapeutic efficacy of such therapeutic compositions may be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Therapeutic compositions which exhibit high therapeutic indices are preferred. While compounds that exhibit toxic side effects can be used, care should be taken to design a delivery system that targets such compounds to the site of affected location to minimize potential damage to uninfected cells and, thereby, reduce side effects.

Data obtained from cell culture assays and animal studies can be used in formulating a range of dosage for use in humans. The dosage of such compounds lies preferably within a range of circulating concentrations that include the $ED_{50}$ with little or no toxicity. The dosage can vary within this range depending upon the dosage form employed and the route of administration utilized. For any compound used in the method of the disclosure, the therapeutically effective dose can be estimated initially from cell culture assays. A dose can be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In some embodiments, a therapeutically effective amount of a therapeutic composition (i.e., an effective dosage) may range from about 0.001 μg/kg to about 250 g/kg, 0.01 μg/kg to 10 g/kg, or 0.1 μg/kg to 1 g/kg or about or at least: 0.001, 0.002, 0.003, 0.004, 0.005, 0.006, 0.007, 0.008, 0.009; 0.01, 0.02, 0.03, 0.04, 0.05, 0.06, 0.07, 0.08, 0.09; 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 125, 150, 175, 200, 225, or 250 grams or micrograms per kilogram of patient body weight, or other ranges that would be apparent and understood by artisans without undue experimentation. The skilled artisan will appreciate that certain factors can influence the dosage and timing required to effectively treat a subject, including but not limited to the severity of the disease or disorder, previous treatments, the general health or age of the subject, and other diseases present.

In other embodiments, a therapeutically effective amount of Globo-H moiety in the therapeutic composition (i.e., an effective dosage) may range from about 0.001 μg/kg to about 250 g/kg, 0.01 μg/kg to 10 g/kg, or 0.1 μg/kg to 1 g/kg or about or at least: 0.001, 0.002, 0.003, 0.004, 0.005, 0.006, 0.007, 0.008, 0.009; 0.01, 0.02, 0.03, 0.04, 0.05, 0.06, 0.07, 0.08, 0.09; 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 125, 150, 175, 200, 225, or 250 grams or micrograms per kilogram of patient body weight, or other ranges that would be apparent and understood by artisans without undue experimentation. The skilled artisan will appreciate that certain factors can influence the dosage and timing required to effectively treat a subject, including but not limited to the severity of the disease or disorder, previous treatments, the general health or age of the subject, and other diseases present.

In certain embodiments, the therapeutic compositions disclosed herein contain or are associated with, at least one therapeutic conjugate or therapeutic antibody whereby each at least one therapeutic conjugate or therapeutic antibody is present in single dose at a concentration of about, at least or more than: 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98 or 99 each times $10^{-9}$, $10^{-8}$, $10^{-7}$, $10^{-7}$, $10^{-6}$, $10^{-5}$, $10^{-4}$, $10^{-3}$, $10^{-2}$, $10^{-1}$ molar per dose. Preferably, the therapeutic conjugate is present in single dose at a concentration between about: 1-100, 2-60, 3-50, 4-40, 5-30, 6-20, 7-15, 8-10, 2-18, 3-16, 4-14, 5-12, 6-10 or 7-8 μM.

In some embodiments, the therapeutic compositions disclosed herein contain or are associated with, at least one therapeutic conjugate or therapeutic antibody whereby each at least one therapeutic conjugate or therapeutic antibody is present in single dose at a concentration of about, at least or more than: 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98 or 99 each times $10^{-3}$, $10^{-2}$, $10^{-1}$, or 10 micrograms. In certain embodiments about or at least 10, 20, 30, 40, 50, 60, 70, 80, 90, 100, 110, 120, 130, 140, 150 or more micrograms of one therapeutic conjugate or therapeutic antibody is included per dose.

In certain embodiments, the therapeutic compositions disclosed herein are administered in a dose about or at least or more than: 1, 2, 3, 4, 5, 6, 7, 8, 9, 10, 11, 12, 13, 14, 15, 16, 17, 18, 19, 20, 21, 22, 23 or 24 times per day, week or month over a period of about or at least or more than: 1, 2, 3, 4, 5, 6, 7, 8, 9, 10, 11, 12, 13, 14, 15, 16, 17, 18, 19, 20, 21, 22, 23 or 24 days, weeks, months, or years.

Kits

According to another aspect, one or more kits of parts can be envisioned by the person skilled in the art, the kits of parts to perform at least one of the methods herein disclosed, the kit of parts comprising one or more therapeutic conjugates, anti-cancer/anti-proliferative agents, adjuvants, cytokines and/or chemokines. The therapeutic compositions comprising alone or in combination an effective amount of the therapeutic compositions disclosed herein according to the at least one of the above mentioned methods. The aforementioned agents may come in a single container or in different containers in the kit.

The kits possibly include also identifiers of a biological event, or other compounds identifiable by a person skilled upon reading of the present disclosure. The kit can also comprise at least one composition comprising an effective amount of the therapeutic compositions disclosed herein. The therapeutic compositions of the kits to perform the at least one method herein disclosed according to procedure identifiable by a person skilled in the art.

The disclosure also includes methods of treating proliferative diseases utilizing the therapeutic compositions disclosed herein. In one embodiment, the methods involve the treatment of cancer, e.g., breast cancer. The methods generally involve providing the therapeutic compositions disclosed herein to a patient in need thereof in an amount effective to treat the proliferative disorder.

In some embodiments, the therapeutic compositions of the invention are administered to a subject in need thereof (e.g., one having a cancer such as breast cancer) in a method that on average extends progression free survival or overall survival over a control placebo, e.g., a phosphate buffered saline placebo, by about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40 days, weeks, months, or years.

In some embodiments, the therapeutic compositions are given subcutaneously on week 0-2, 6, 14, and 26 in the absence of unacceptable toxicity or disease progression.

In some embodiments, the therapeutic compositions of the invention are administered to a subject in need thereof (e.g., one having a cancer such as breast cancer) in a method that on average shrinks the volume of a tumor in the patient relative to a control placebo, e.g., a phosphate buffered saline placebo, by about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51 52 53 54 55 56 57 58 59 60 61 62 63 64 65 66 67 68 69 70 71 72 73 74 74 76 77 78 79 80 81 82 83 84 85 86 87 88 89 90 91 92 93 94 95 96 97 98 99 or more percent over the course of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40 days, weeks, months, or years.

In some embodiments, tumors volumes may be accurately measured in at least one dimension (longest diameter in the plane of measurement is to be recorded) with a minimum size of 10 mm by CT scan (CT scan slice thickness recommended to be in between 2.5 mm and 5 mm).

Methods of Synthesizing the Compositions of the Invention

The Globo H hexasaccharide portion of the therapeutic compositions of the invention was chemically synthesized as the allyl glycoside and then prepared for conjugation with KLH.

In one illustrative embodiment, the chemical synthesis of Globo H involves the following general steps:

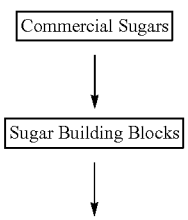

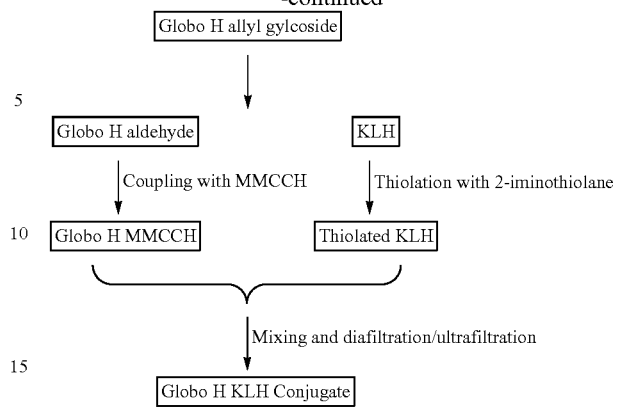

KLH was treated with 2-iminothiolane in an aqueous buffer. The thiolated KLH was then isolated from the unreacted 2-iminothiolane, via a size exclusion column of Sephadex G-15 column. The thiolated KLH was stored under inert gas (nitrogen or argon) atmosphere and used immediately for the conjugation with Globo HMMCCH.

EXAMPLES

Example 1

Preparation of Glycoconjugate of the Invention (Globo H-KLH)

Globo H allyl glycoside (commercially available) was converted to an aldehyde by ozonolysis. Globo H aldehyde was reacted with $M_2C_2H$ (linker) and $NaCNBH_3$ to give Globo H-MMCCH. The mixture was purified with a column to receive Globo H-MMCCH. The fraction with Globo H-MMCCH positive was confirmed by high performance liquid chromatography (HPLC) and then pooled together. KLH was dissolved in thiolation buffer and 2-iminothiolane was added into the reaction by portion. The reaction was incubated to completion and then KLH-SH was purified by a column. Globo H-MMCCH and KLH-SH were combined 2. The reaction was stirred to completion. Globo H-KLH was then purified to provide the final product.

Example 2

Analysis of Weight Ratio of Globo H to KLH in the Glycoconjugate

The weight ratio of Globo H and KLH in the glycoconjugate as prepared was confirmed by high performance anion exchange chromatography with pulsed amperometric detection (HPAEC-PAD). The results are shown in Table 3.

TABLE 3

The Weight Ratio of Globo H and KLH in Glycoconjugate

| Glycoconjugate preparations Epitope Ratio (KLH Didecamer MW: 8,600,000 Da) | Epitope ratio (KLH monomer MW: 400 kDa) | Globo H Weight to KLH moiety Weight (mg/mg) |
|---|---|---|
| 3000 | 150 | 0.368 |
| 1950 | 97.5 | 0.239 |
| 1500 | 75 | 0.184 |
| 1050 | 52.5 | 0.129 |

TABLE 3-continued

The Weight Ratio of Globo H and KLH in Glycoconjugate

| Glycoconjugate preparations Epitope Ratio (KLH Didecamer MW: 8,600,000 Da) | Epitope ratio (KLH monomer MW: 400 kDa) | Globo H Weight to KLH moiety Weight (mg/mg) |
|---|---|---|
| 300 | 15 | 0.037 |
| 100 | 5 | 0.012 |
| 20 | 1 | 0.002 |

Example 3

Analysis of Epitope Ratio of Globo H to KLH in the Glycoconjugate

The molecular weight of a KLH didecamer (the naturally aggregated form) is around 7.5 MDa~8.6 MDa, as described in literatures, such as Micron 30 (1999) 597-623. The native KLH was confirmed by the size exclusion chromatography and multi-angle laser scattering spectrometry (MALS), having the molecular weight of around 8.6 M Da (see FIGS. 3 and 4). The glycoconjugates of the invention (sample no. 5, the weight ratio of Globo H to KLH being 0.17:1) were analyzed by the size exclusion chromatography. The results show that the glycoconjugate of the invention exhibited a reduced mass in molecular weight as compared with native aggregated KLH didecamers. See FIG. 4. The molecular ratios were then calculated as in Table 4.

TABLE 4

Calculation of Molecular Ratios of Globo H to KLH

| Experimental Molecular Weight from Globo H-KLH (kDa) | Mass of 75 Globo H per KLH subunit in Globo H-KLH: 75 (kDa) | Mass of KLH subunit: 359 kDa | Assumption of (Globo H)-(KLH multimer) from the experimental data |
|---|---|---|---|
| 1142 | 3 * 75 = 225 | 359 * 3 = 1077 | 225 + 1077 = 1302 KLH forms a trimer after Globo H-KLH conjugation. |
| 780 | 2 * 75 = 150 | 359 * 2 = 718 | 150 + 718 = 868 KLH forms a dimer after Globo H-KLH conjugation. |
| 420 | 1 * 75 = 75 | 359 * 1 = 359 | 434 KLH forms a monomer after Globo H-KLH conjugation. |

*The above molecular ratio is calculated based on the formula as below:

$$\text{molecular ratio} = \frac{\text{Globo } H \text{ Weight/Globo } H \text{ M.W.}}{\frac{KLH \text{ Weight}}{KLH \text{ Molecular Weight}^{**}}}$$

** The molecular weight of KLH depends on the forms of monomer, dimer or didecamer Given the above, it was concluded that in the glycoconjugate of the invention, the KLH monomeric units form monomers, dimers and/or trimers after conjugation to Globo H.

Example 4

Preparation of Vaccine Compositions and Immunization in Rats

Different samples of the glycoconjugates (Globo H-KLH) as prepared in Example 1 were stored at 4° C., and mixed with a saponin adjuvant under a laminar flow hood. The resultant vaccine compositions were placed on ice and transported to animal facility for subsequent immunization.

Three groups of Lewis rats were immunized with the various vaccine compositions as shown in Table 5.

TABLE 5

Groups of immunized rats

| Groups | Vaccine compositions | Animal number | Route |
|---|---|---|---|
| I | GH-KLH* (25 µg) + saponin adjuvant (25 µg) | 8 | SC |
| II | GH-KLH* (7.5 µg) + saponin adjuvant (25 µg) | 4 | SC |
| III | PBS | 4 | SC |

*GH:KLH = 0.17:1 (w/w)
GH: Globo H
SC: Subcutaneous
PBS: phosphate buffered saline The rats were immunized on day 0, 7, 14, and 21. Peripheral blood mononuclear cells (PBMC) and plasma were collected on day 0, 3, 10, 17, 24, and 31. Spleen, lymph node, and peritoneal wash were harvested on day 31.

Example 5

Assays for Induction of Humoral and Cellular Immune Responses in Rats

Example 5.1 Analysis of Immune Effector Cell Subpopulations by Flow Cytometry

Figure 5A:
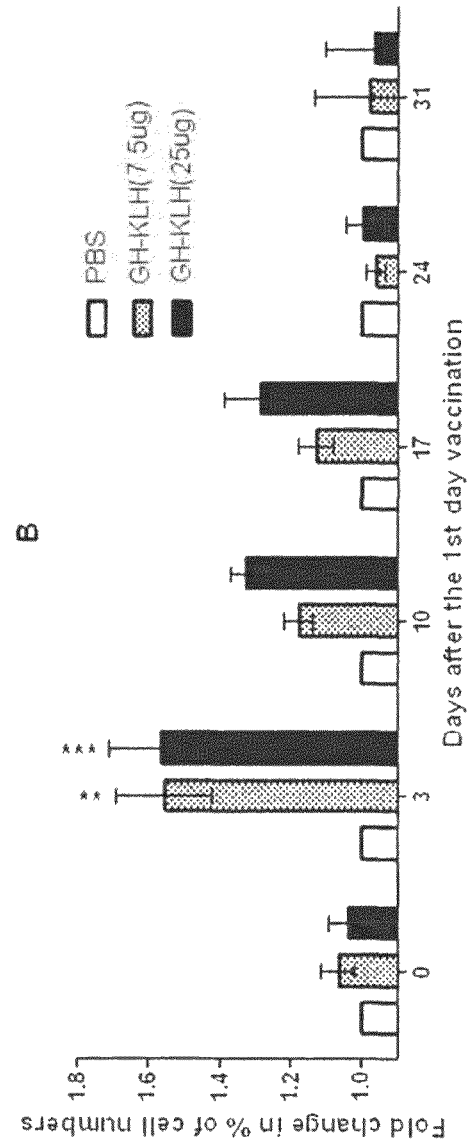
Figure 5B:
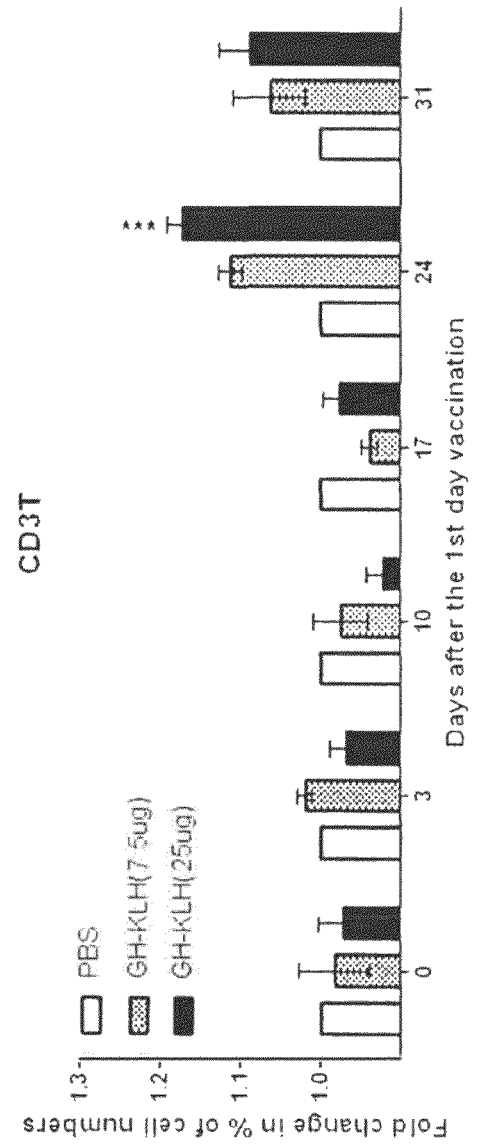
Figure 7:
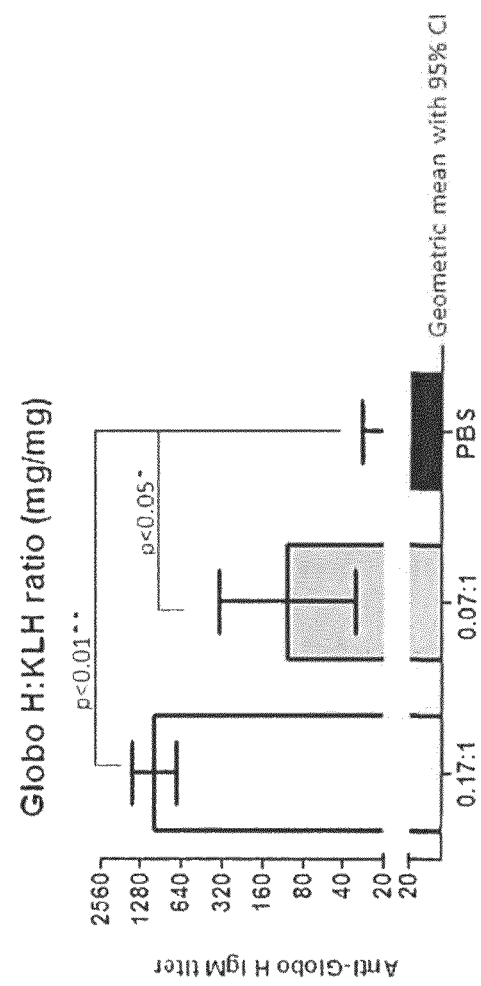
FIG. 7 shows the IgM antibody titers in mice in response to the glycoconjugate (Globo H-KLH) of the invention.
Figure 8:
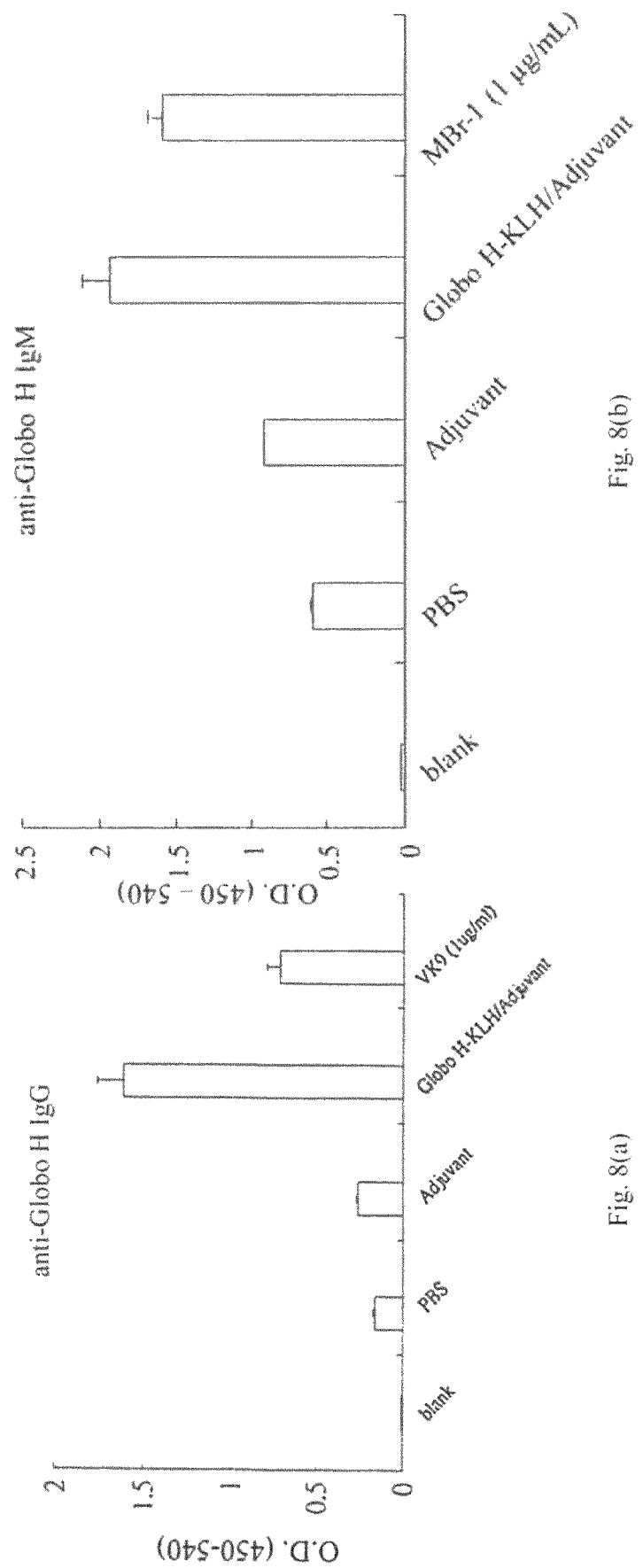
FIG. 8A-B illustrates the immunogenicity of C57BL/6 mice that were immunized with PBS, adjuvant only, or Globo H-KLH+adjuvant on day 0, 5, and 10. The sera were collected on day 14 for ELISA analysis to determine the anti-Globo H IgG and IgM production.
Figure 9:
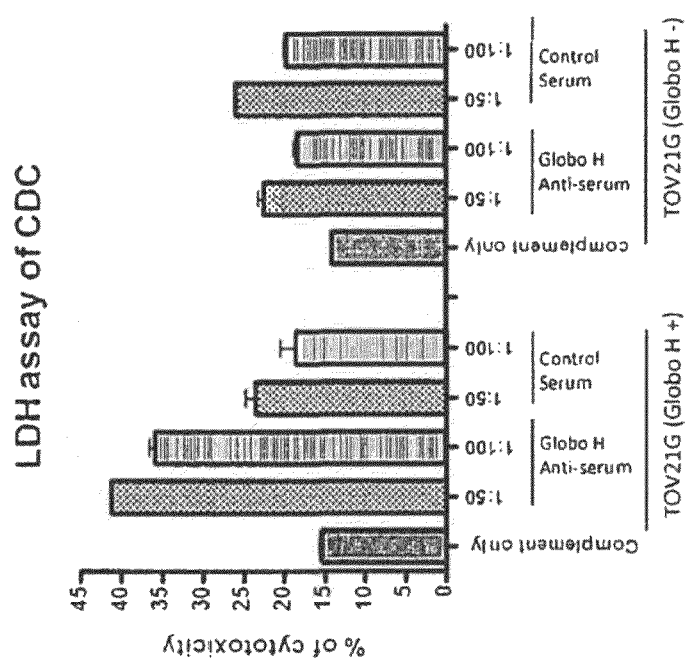
FIG. 9 illustrates the complement dependent cytotoxicity in which Globo H(+) or Globo H(−) TOV21G cells were plated in a 96-well plate. Anti-Globo H sera or control sera were added at a dilution of 1:50 or 1:100. The plate was then added with/without complement. The complement dependent cytotoxicity (CDC) was determined by LDH assay.
Figure 10:
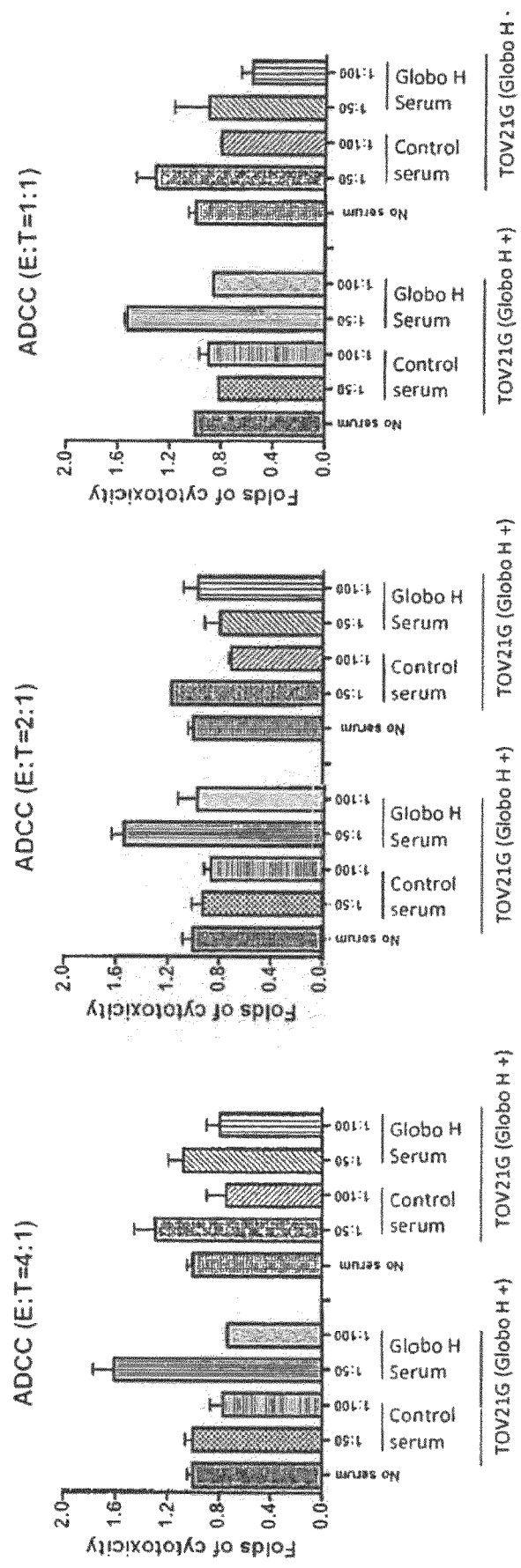
FIG. 10A-C illustrates the cytotoxicity of Globo H(+) or Globo H(−) TOV21G cells that were plated in a 96-well plate. Anti-Globo H sera or control sera were added at a dilution of 1:50 or 1:100. Human NK cells isolated from peripheral blood mononuclear cells (PBMCs) and activated with anti-CD3 antibody were used as effector cells. The effector cells were or were not then added for antibody-dependent cell-mediated cytotoxicity (ADCC) reaction at a ET ratio of 4:1, 2:1, or 1:1. The cytotoxicity was normalization with no mouse serum control of each cells in different ET ratio.
Figure 11:
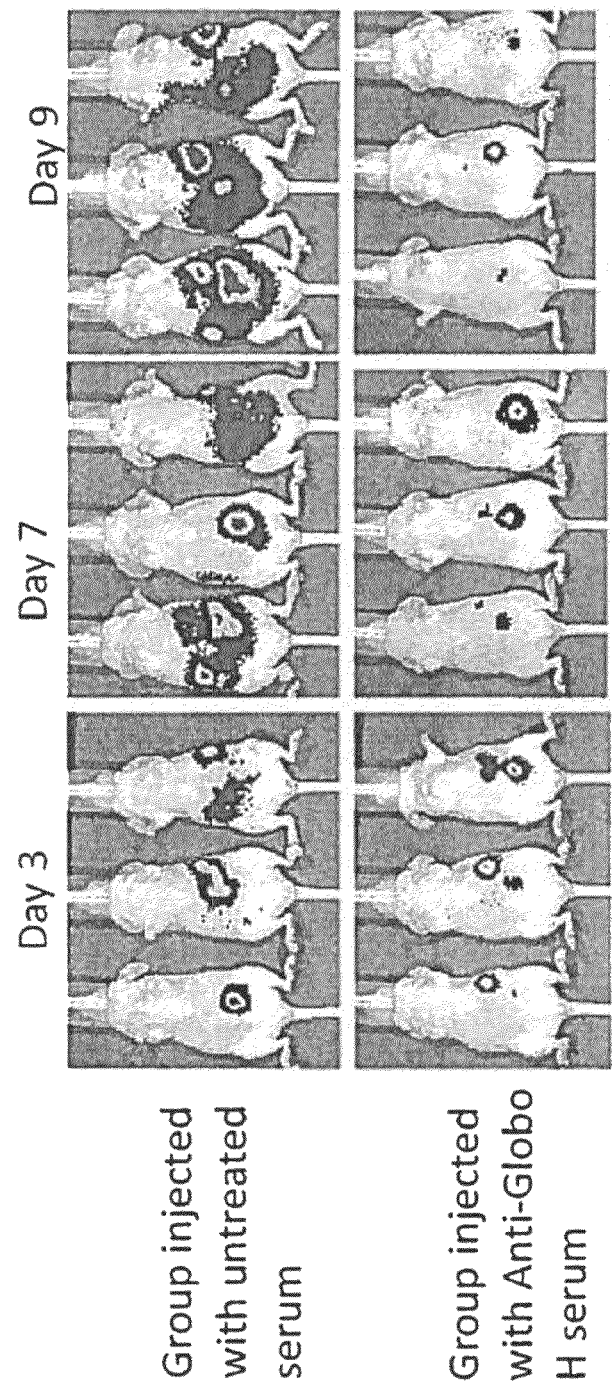
FIG. 11 illustrates irradiated NOD-SCID mice that were injected intraperitoneally with 1×10 6 of Globo H-positive TOV21G cells on day 0. Anti-sera were separately collected from C57BL/6 mice after 3 vaccinations of 3 different treatments (PBS, adjuvant only, and Globo H-KLH/adjuvant). The NOD-SCID mice were given intraperitoneally 200 µl of aforementioned anti-sera for each mouse on day 0, 2, 4, 6, 9, 11, 13, and 16. The tumor images were traced by IVIS imaging system on day 3, 7, and 9.
Figure 12:
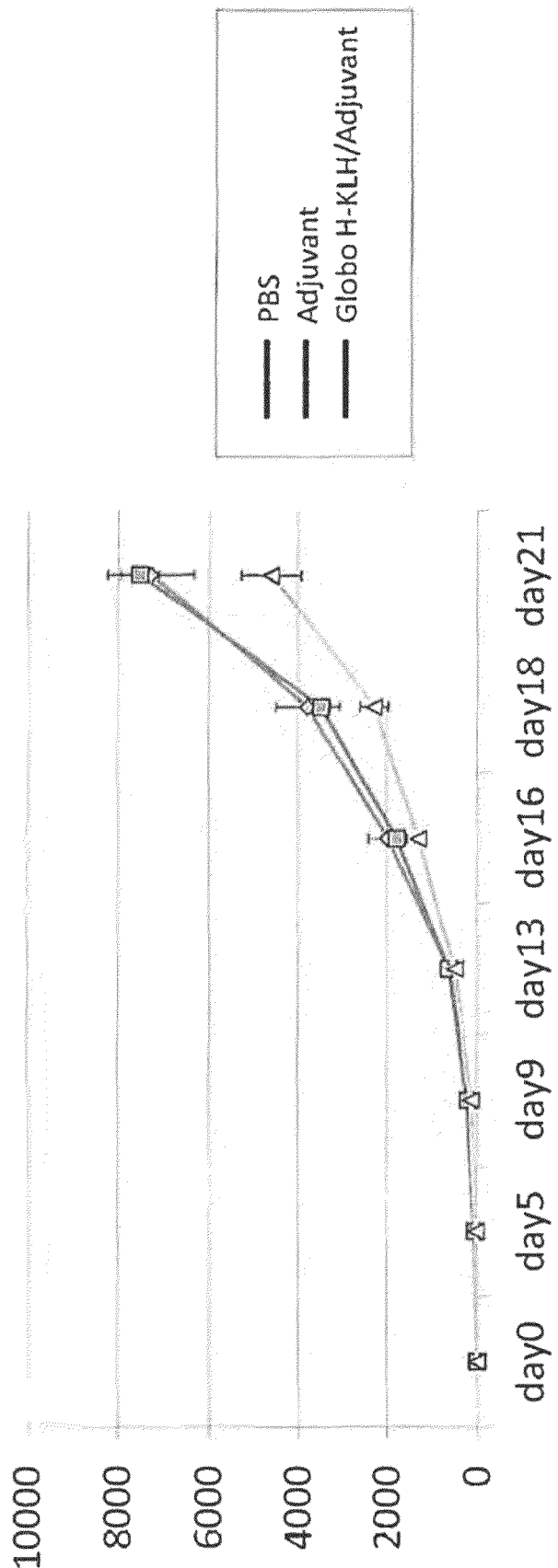
FIG. 12 illustrates LLC1 (a lung cancer epithelial cancer cell line) tumor growth on Globo H KLH immunized C57BL/6 mice that were subcutaneously vaccinated with PBS, adjuvant only, or Globo H-KLH/adjuvant on day 0, 5, and 11. 1×105 LLC1 cells were subcutaneously injected into each mouse on day 16. The treatments were then subcutaneously administered on day 29 and 34. Tumor sizes were monitored on day 16, 21, 25, 29, 32, 34, 37.

The peripheral blood mononuclear cells (PBMCs) were isolated from the animals and then various immune effector cell subpopulations in the PBMC were identified by flow cytometry using specific antibodies against different cell markers The PBMCs, isolated from the immunized rats on day 0, 3, 10, 17, 24, and 31, were stained with different fluorescence (FITC)-conjugated antibodies and placed on ice for 30 minutes. After incubation, cells were washed with the washing buffer (1% bovine serum albumin (Sigma) and 0.1% $NaN_3$ (Sigma) in phosphate buffered saline (UniRegion Biotech) and centrifuged at 350 g for 5 minutes. Cells were resuspended in washing buffer for determination of fluorescence by FACS Canto (BD Bioscience). The data were analyzed with BD FACSDiva (BD Bioscience) software. The results show that in the immunized rats by the glycoconjugate of the present invention, T cells, B cells, CD4+ T cells, and CD8+ T cells were significantly expanded when compared to the PBS control group. Specifically, the B cell population first appeared at day 3 and subsequent $CD3^+$ T, $CD4^+$ T and $CD8^+$ T cells appeared at day 24. See FIG. 5 (A)-(D).

Example 5.2 Globo H-Specific Antibody Test by ELISA

The production of Globo H-specific antibodies in the plasma from the immunized rats was determined by ELISA assay. The results show the titers of Globo H-specific IgG began to rise at 10 days and peaked at 17 days after immunization. Similar patterns were observed in the production of Globo H-specific IgM antibody. See FIG. 5 (A)-(B). There was no response of Globo H-specific IgG and IgM antibody in rats treated with PBS, or KLH plus adjuvant only (data not shown).

In summary, in the immunized rats, B cell production appears at day 3, followed by production of IgM and IgG antibody against Globo H which appears at day 10 and subsequent $CD3^+$ T, $CD4^+$ T, and $CD8^+$ T cell which appears at day 24. The glycoconjugate (Globo H-KLH) of the invention is effective to induce both humoral and cellular responses.

Example 6

Immunization in Mice and Antibody Test by ELISA

Different samples of the glycoconjugates (Globo H-KLH) were stored at 4° C., and mixed with a saponin adjuvant under a laminar flow hood. The resultant vaccine compositions were placed on ice and transported to animal facility for subsequent immunization.

Balb/c mice of approximately eight weeks old were given Globo H-KLH with different carbohydrate-to-protein (Globo H: KLH) ratios once every week for four weeks (Day 0, 7, 14, and 21) via subcutaneous injection. Blood samples were collected through retro-orbital or facial vein without anticoagulant pre-immune or Day 0, and three days after each vaccination (Day 10, 17 and 24). Samples were then centrifuged to separate sera and red cells. Sera were collected and stored at −20° C., which were later analyzed by ELISA. Mann-Whitney t-test was used for statistical analysis.

As shown in FIG. 6, the glycoconjugate (Globo H-KLH), in combination with a saponin adjuvant, according to the invention, has been demonstrated to significantly induce the Globo H-specific IgM antibody responses in the animal model, as compared with the PBS control group. Specifically, the glycoconjugate with a weight ratio of 0.17:1 (Globo H: KLH) induced a better antibody titer than the glycoconjugate with a weight ratio of 0.07:1 (Globo H: KLH).

In summary, the glycoconjugate (Globo H-KLH), in combination with a proper adjuvant, according to the invention, has been demonstrated to induce unexpectedly superior humoral and cellular immune response in the animal model, particularly expansion of B cells and T cells including CTLs and IgM and IgG responses, which are important in cancer immunotherapy.

Example 7

Immunogenicity Study of Globo H-KLH with or without Adjuvant Vaccine in Mice

The ability of Globo H composition of the invention, when paired with an adjuvant, to elicit an immune response in mice has been performed. The amount of Globo-H specific antibody induced by the immunotherapy was quantified by an ELISA and FACS.

Groups of 6-week-old female C57BL/6 mice were immunized subcutaneously with Globo H-KLH and adjuvant. Globo H-KLH dose levels are the equivalent of amount of Globo-H (in μg) in Globo H-KLH. Each injection contained a range of doses equivalent to 0.6 μg to 5.0 μg Globo-H in Globo H-KLH and 20 μg adjuvant. The immunizations occurred on Days 0, 8, and 14, and serum was collected on Day 0 (pre-injection) and Day 24 for comparative analysis by ELISA and FACS. Serological responses were measured by ELISA to determine the titer of antibodies against Globo H ceramide, and FACS to determine cell surface reactivity to Globo H positive MCF-7 cells.

Throughout the immunization, there was no obvious change in the behavior, appetite, general appearance, and grooming after vaccination. Ten days after the third immunization, sera were collected for determination of IgG and IgM anti-Globo H antibody titers by ELISA, using a titer fold of the pre-treatment value as a criterion for positive response. As shown in FIG. 2, there was no response in mice treated with Globo H alone, Globo H KLH conjugate, or adjuvant alone. In contrast, 14/15 mice treated with Globo H-KLH+adjuvant responded with significant IgG anti-Globo H titers which did not appear to be dose dependent at an Globo H-KLH dosage of 0.6 to 5 μg. The average IgG titers for each dosage increased by 13 to 17.5 fold over the pre-treatment value. As to IgM anti-Globo H, one of the 15 mice showed an 8-fold increase in titer after immunization with adjuvant+Globo H-KLH. However, 5/15 had an IgM titer 4 fold of preimmune sera and a total of 6/15 had a titer fold. The average IgM titers for each dosage increased by 2.5 fold over the pretreatment values.

Figure 3:
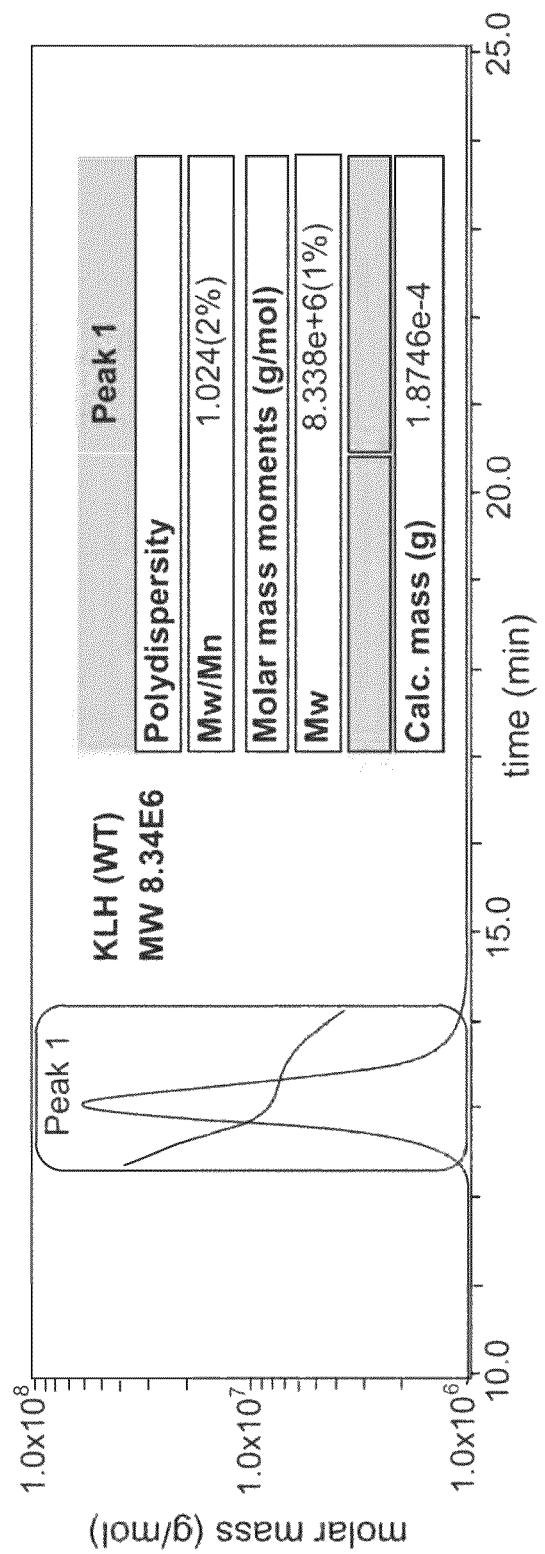
FIG. 3 shows the result of multi-angle laser scattering spectrometry (MALS) of native KLH (8.3 MDa).
Figure 4:
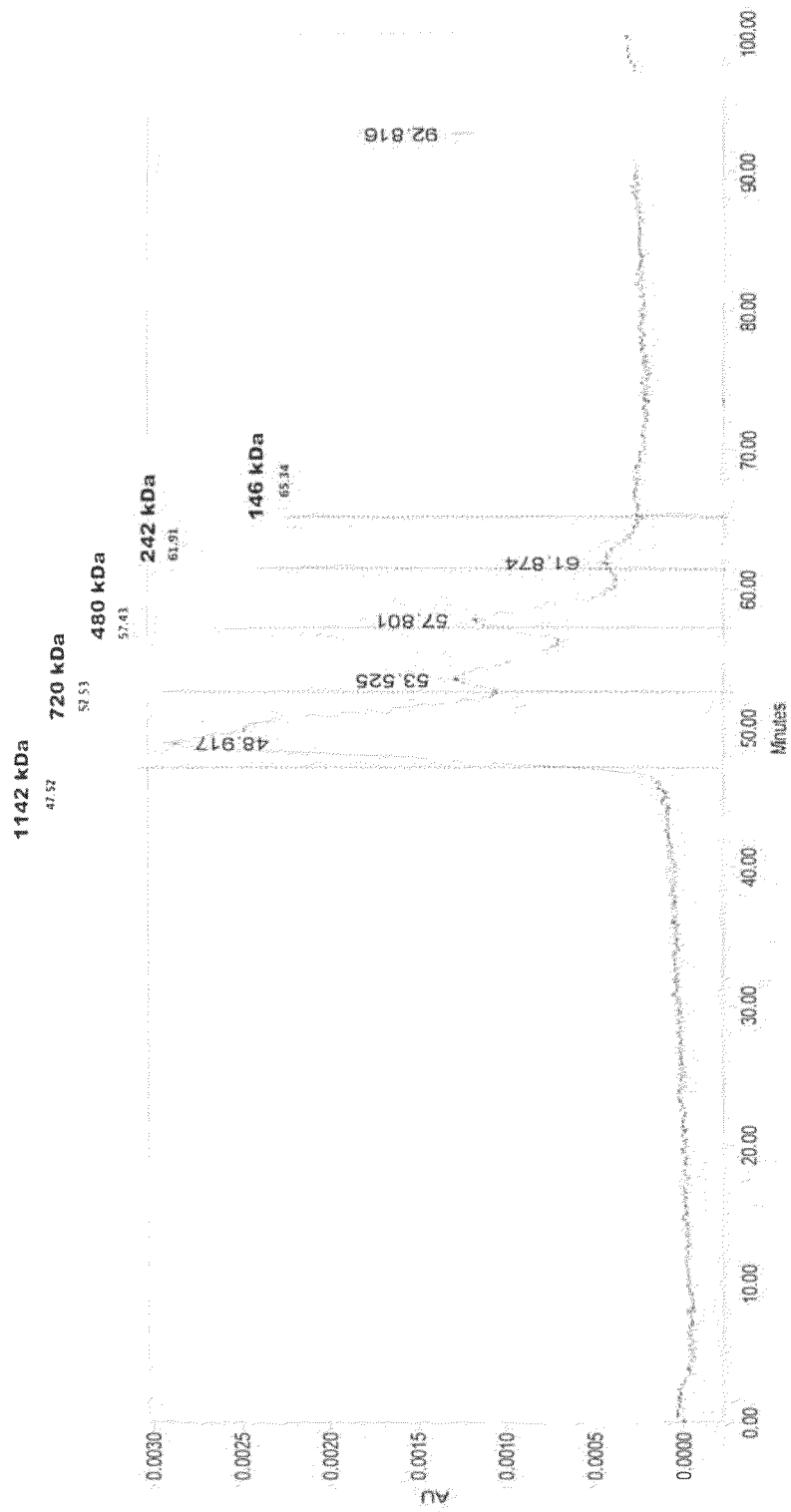
FIG. 4 shows the result of size exclusion chromatography of native KLH (8.3 MDa).

The binding capacity of immune sera with Globo H-expressing breast cancer cell line, MCF-7 was determined by FACS analysis at 1:25 serum dilution. The post-treatment value of 30% above the pretreatment value (i.e. ≥1.3 fold increase) was considered as positive in this assay. As shown in FIG. 3, immune sera from all of the adjuvant+Globo H-KLH treated groups contained IgM antibodies that reacted with MCF-7 cells, which ranged from 5-6 fold over pretreatment baseline. Moreover, immune sera from three-fifths of the mice treated with 0.6 μg or 2 μg Globo H-KLH+adjuvant, and two-fifths of those treated with 5 μg Globo H-KLH+adjuvant showed IgG antibodies that could bind to MCF-7 cells. The average binding capacities increased 1.3 to 2.0 fold over the pretreatment baseline.

Vaccination with Globo H-KLH and an adjuvant has demonstrated to elicit both IgG and IgM anti-Globo H responses in female C57BL/6 mice. The immune sera had the capacity of binding Globo H expressing breast cancer MCF-7 cells.

Example 8

LC-MS/MS Analysis of Globo-H Conjugation Sites on KLH

Globo H conjugation sites in four KLH samples using multiple enzyme digestion and LC-MS/MS were identified. The four Globo H-conjugated KLH samples were first digested with four different enzymes and then analyzed by LC-MS/MS and Mascot database search. Two types of derivatives were identified: Globo H derivative (Globo H+MMCCH) and the MMCCH derivative (MMCCH alone). The Globo H derivative and its neutral loss forms were taken into account for Globo H conjugation site identification. The MMCCH form and its deamidated form were taken into account for MMCCH conjugation site identification. Only those peptides with high quality MS/MS spectra and Mascot score were taken into account. For Globo H conjugation analysis, 31 and 28 conjugated lysines were observed from the two replicate LC-MS/MS analyses of OBI-822-13001-DP (sample 1); 19 and 21 conjugated lysines were observed from the two replicate LC-MS/MS analyses of OBI-822-13002-DP (sample 2); 10 and 11 conjugated lysines were observed from the two replicate LC-MS/MS analyses of OBI-822-13003-DP (sample 3); 18 and 19 conjugated lysines were observed from the two replicate LC-MS/MS analyses of OBI-822-13004-DS (sample 4). For MMCCH conjugation analysis, 155 and 141 conjugated lysines were found from the two replicate LC-MS/MS analyses of OBI-822-13001-DP (sample 1); 143 and 137 conjugated lysines were found from the two replicate LC-MS/MS analyses of OBI-822-13002-DP (sample 2); 147 and 143 conjugated lysines were found from the two replicate LC-MS/MS analyses of OBI-822-13003-DP (sample 3); 140 and 136 conjugated lysines were found from the two replicate LC-MS/MS analyses of OBI-822-13004-DS (sample 4).

Example 8

Materials and Methods

Abbreviations in this section are as follows: K=Lysine; LC-MS/MS=Liquid Chromatography-Tandem Mass Spectrometry; DTT=Dithiolthreitol; IAM=Iodoacetamide; ACN=Acetonitrile; FA=Formic Acid; Glu-C=Endoproteinase Glu-C; ABC=Ammonium bicarbonate; RT=Room temperature; MW=Molecular weight.

The four KLH samples, sample 1-4, were first processed for buffer exchange into 50 mM ammonium bicarbonate buffer solution by 100 kDa cut-off Amicon Ultra Centrifugal Filters and denatured with 6 M urea. The samples were then reduced with 10 mM DTT at 37° C. for 1 hr, alkylated using 50 mM IAM for 30 mins in dark at RT and quenched with 50 mM DTT at RT for 5 mins. The resulting proteins were diluted until the urea concentration is 1 M and subjected to in-solution digestion with different enzymes as described in the following section.

In-solution digestion with different enzymes was performed with the following digestion conditions: (1) trypsin digestion at 37° C. for 24 hrs (protein:enzyme=40:1) (2) Glu-C digestion at 37° C. for 24 hrs (protein:enzyme=25:1); (3) chymotrypsin digestion at RT for 24 hrs (protein:enzyme=25:1); (4) thermolysin digestion at 37° C. for 24 hrs (protein:enzyme=25:1).

Digestion reactions were terminated by adding formic acid and all four digested samples were subjected to LC-MS/MS analysis.

Samples were analyzed with Q Exactive mass spectrometer (Thermo Scientific) coupled with Ultimate 3000 RSLC system (Dionex). The LC separation was performed using the C 18 column (Acclaim PepMap RSLC, 75 μm×150 mm, 2 μm, 100 Å) with the gradient shown below:

| Time (min) | A % | B % | Flow (μL/min) |
| --- | --- | --- | --- |
| 0 | 99 | 1 | 0.25 |
| 5 | 99 | 1 | 0.25 |
| 35 | 90 | 10 | 0.25 |
| 67 | 65 | 35 | 0.25 |
| 77 | 15 | 85 | 0.25 |
| 82 | 99 | 1 | 0.25 |
| 90 | 99 | 1 | 0.25 |

Mobile phase A: 5% ACN/0.1% FA

Mobile phase B: 95% ACN/0.1% FA

In-source CID was set at 45 eV. Full MS scan was performed with the range of m/z 350-2000, and the ten most intense ions from MS scan were subjected to fragmentation for MS/MS spectra. Raw data were processed into peak lists by Proteome Discoverer 1.4 for Mascot database search.

Database search was performed with Mascot version 2.4.1 and Thermo Proteome Discoverer version 1.4 against the KLH1 and KLH2 [KLH1, EMBL accession # CAG28307.1; KLH2, EMBL accession # CAG28308.1. The parameters used were as follows: Enzyme: Trypsin, Glu-C, Chymotrypsin and Thermolysin according to the digestion method; Fixed modification: Carbamidomethyl (C).

Variable modifications for MMCCH derivatives (MMCCH alone): Deamidated (NQ), Oxidation (M), dK_MMCCH-1 (K), dK_MMCCH-2 (K).

Variable modifications for Globo H derivatives (Globo H+MMCCH):

Deamidated (NQ), Oxidation (M), Globo_H_MMCCH (K), dK_MMCCH_NL997 (K), dK_MMCCH_NL835 (K), dK_MMCCH_NL673 (K), dK_MMCCH_NL511 (K), dK_MMCCH_NL308 (K), Deamidated (NQ), Oxidation (M), Peptide Mass Tolerance: ±10 ppm; Fragment Mass Tolerance: ±0.05 Da; Max Missed Cleavages: 5; Instrument type: ESI-TRAP; Ion cut-off score: 13.

"dK_MMCCH-1" in the search parameters indicates the MMCCH-conjugated lysine with the MW addition of 352.1569 Da.

"dK_MMCCH-2" in the search parameters indicates the deamidated form of MMCCH-conjugated lysine with the MW addition of 338.1300 Da.

"Globo_H_MMCCH (K)" in the search parameters indicates the Globo H-conjugated lysine with the MW addition of 1393.5317 Da.

"dK_MMCCH_NL997" in the search parameters indicates the neutral loss form of Globo H-conjugated lysine with the MW addition of 396.1831 Da.

"dK_MMCCH_NL835" in the search parameters indicates the neutral loss form of Globo H-conjugated lysine with the MW addition of 558.2360 Da.

"dK_MMCCH_NL673" in the search parameters indicates the neutral loss form of Globo H-conjugated lysine with the MW addition of 720.2888 Da.

"dK_MMCCH_NL511" in the search parameters indicates the neutral loss form of Globo H-conjugated lysine with the MW addition of 882.3416 Da.

"dK_MMCCH_NL308" in the search parameters indicates the neutral loss form of Globo H-conjugated lysine with the MW addition of 1085.4210 Da.

The "MW addition" implies the molecular weight addition compared to intact lysine residue.

Example 8

Results

LC-MS/MS based techniques are tools for identification of protein and characterization of amino acid modification. Detailed information regarding peptide sequences and modification sites can be obtained by the assignment of fragment ions provided by MS/MS spectra. Mascot is a search engine and its probability based scoring algorithm has been well accepted. Mascot score was adopted in this study as a reference of confidence for protein sequencing and Globo H or MMCCH conjugation site identification. To extensively analyze the distribution of Globo H or MMCCH conjugation sites in sample 1-4, these samples were digested with multiple enzymes followed by LC-MS/MS analyses.

The expected chemical structure for Globo H derivative (Globo H+MMCCH) is shown in FIG. 33A and the corresponding MW addition of 1393.53 Da on lysine-containing peptides can be observed among the results. Besides, the labile polysaccharides tend to fall off via neutral loss during the electrospray ionization in LC-MS analysis. Therefore, the molecular weight addition of 396.18 Da, 558.24 Da, 720.29 Da, 882.34 Da and 1085.42 Da resulted from neutral loss can also be observed for glycoconjugated peptides, as shown in FIG. 33B. All the derivitization forms were considered for the identification of Globo H conjugation sites.

In addition, the MMCCH derivative is also observed (MMCCH alone) in these Globo H conjugated KLH samples. The expected chemical structure for MMCCH derivative and its deamidated form are shown in FIGS. 34A and 34B and the corresponding MW addition of 352.16 Da and 338.13 Da respectively on lysine-containing peptides can be observed among the results. Both derivitization forms were considered for the identification of MMCCH conjugation sites. The conversion from Globo H derivative to MMCCH is not clear but it is supposed to happen during the sample treatment.

The mass accuracy of ±10 ppm for precursor ion and ±0.05 Da for fragment ion were used as the criteria for protein identification and spectra interpretation. The Globo H derivative as well as its neutral loss forms was chosen as variable modification for Globo H conjugation site identification, and MMCCH derivative as well as its deamidated form was chosen as variable modification for MMCCH conjugation site identification. Database search was performed against the sequence of KLH1 and KLH2 provided by sponsor. Only those peptides with high quality MS/MS spectra (ion score≥13, p<0.05) were listed in the report.

To demonstrate a repeatable result, the LC-MS/MS analysis was performed twice followed by individual Mascot database search for both Globo H conjugation site identification and MMCCH conjunction site identification, as summarized in FIG. 17.

In Globo H conjugation site analysis, 31 and 28 lysines were found respectively in 1st LC-MS/MS and 2nd LC-MS/MS for sample 1; 19 and 21 lysines were found respectively in 1st LC-MS/MS and 2nd LC-MS/MS for sample 2; 10 and 11 lysines were found respectively in 1st LC-MS/MS and 2nd LC-MS/MS for sample 3; 18 and 19 lysines were found respectively in 1st LC-MS/MS and 2nd LC-MS/MS for sample 4. The identification details are listed in FIGS. 14-21. In MMCCH conjugation analysis, 155 and 141 lysines were found respectively in 1st LC-MS/MS and 2nd LC-MS/MS for sample 1; 143 and 137 lysines were found respectively in 1st LC-MS/MS and 2nd LC-MS/MS for sample 2; 147 and 143 lysines were found respectively in 1st LC-MS/MS and 2nd LC-MS/MS for sample 3; 140 and 136 lysines were found respectively in 1st LC-MS/MS and 2nd LC-MS/MS for sample 4. The identification details are listed in FIGS. 22-29.

Globo H conjugation sites from multiple enzyme experiments are summarized in FIG. 30 and MMCCH conjugation sites are summarized in FIG. 31. The overall conjugation site analysis results for Globo H conjugated samples are summarized in FIG. 32.

Example 8

Conclusion

The mass spectrometric signals of Globo H derivative conjugated peptides are lower than those of MMCCH conjugated peptides due to the multiple neutral loss forms and lower ionization efficiency of polysaccharide, which makes the direct identification of Globo H conjugation more difficult. This is why the numbers of identified peptides are higher for MMCCH conjugation analysis. Therefore, the MMCCH results may be used to represent the Globo H conjugation.

The conjugation site analysis suggests that there are 155, 143, 147 and 140 lysine conjugation sites identified among the total 306 lysine residues in KLH1/KLH2 for sample 1-4, respectively. In the replicate analysis, 141, 137, 143 and 136 conjugation sites were identified for samples 1-4, respectively.

Unless defined otherwise, all technical and scientific terms and any acronyms used herein have the same meanings as commonly understood by one of ordinary skill in the art in the field of this invention. Although any compositions, methods, kits, and means for communicating information similar or equivalent to those described herein can be used to practice this invention, the preferred compositions, methods, kits, and means for communicating information are described herein.

All references cited herein are incorporated herein by reference to the full extent allowed by law. The discussion of those references is intended merely to summarize the assertions made by their authors. No admission is made that any reference (or a portion of any reference) is relevant prior art. Applicants reserve the right to challenge the accuracy and pertinence of any cited reference.

SEQUENCE LISTING (1803 sequences)

SEQ ID NO: 1 - protein, 3125 aa, Megathura crenulata
MTPEELKTYLDERSSRARAFASFRLKGFGGSANVFVYVCIPDDNDRNDDHCEKAGDFFVLGGPSEMKWQFYRPYLFDLSDTVHKMGMKLDGHYTVKAELFSVNGTALPDDLLPHPVVVHHPEKGFTDPPVKHHQSANLLVRKNINDLTREEVLNLREAFHKFQEDRSVDGYQATAEYHGLPARCPRPDAKDRYACCVHGMPIFPHWHRLFVTQVEDALVGRGATIGIPYWGLPYWDWTEPMTHIPGLAGNKTYVDSHGASHTNPFHSSVIAFEENAPHTKRQIDQRLFKPATFGHHTDLFNQILYAFEQEDYCDFEVQFEITHNTIHAWTGGSEHFSMSSLHYTAFDPLFYFHHSNVDRLWAVWQALQMRRHKPYRAHCAISLEHMHLKPFAFSSPLNNNEKTHANAMPNKIYDYENVLHYTYEDLTFGGISLENIEKMIHENQQEDRIYAGFLLAGIRTSANVDIFIKTTDSVQHKAGTFAVLGGSKEMKWGFDRVFKFDITHVLKDLDLTADGDFEVTVDITEVDGTKLASSLIPHASVIREHARGKLNRVKFDKVPRSRLIRKNVDRLSPEEMNELRKALALLKEDKSAGGFQQLGAFHGEPKWCPSPEASKKFACCVHGMSVFPHWHRLLTVQSENALRRHGYDGALPYWDWTSPLNHLPELADHEKYVDPEDGVEKHNPWFDGHIDTVDKTTTRSVQNKLFEQPEFGHYTSIAKQVLLALEQDNFCDFEIQYEIAHNYIHALVGGAQPYGMASLRYTAFDPLFYLHHSNTDRIWAIWQALQKYRGKPYNVANCAVTSMREPLQPFGLSANINTDHVTKEHSVPFNVFDYKTNFNYEYDTLEFNGLSISQLNKKLEAIKSQDRFFAGFLLSGFKKSSLVKFNICTDSSNCHPAGEFYLLGDENEMPWAYDRVFKYDITEKLHDLKLHAEDHFYIDYEVFDLKPASLGKDLFKQPSVIHEPRIGHHEGEVYQAEVTSANRIRKNIENLSLGELESLRAAFLEIENDGTYESIAKFHGSPGLCQLNGNPISCCVHGMPTFPHWHRLYVVVVENALLKKGSSVAVPYWDWTKRIEHLPHLISDATYYNSRQHHYETNPFHHGKITHENEITTRDPKDSLFHSDYFYEQVLYALEQDNFCDFEIQLEILHNALHSLLGGKGKYSMSNLDYAAFDPVFFLHHATTDRIWAIWQDLQRFRKRPYREANCAIQLMHTPLQPFDKSDNNDEATKTHATPHDGFEYQNSFGYAYDNLELNHYSIPQLDHMLQERKRHDRVFAGFLLHNIGTSADGHVFVCLPTGEHTKDCSHEAGMFSILGGQTEMSFVFDRLYKLDITKALKKNGVHLQGDFDLEIEITAVNGSHLDSHVIHSPTILFEAGTDSAHTDDGHTEPVMIRKDITQLDKRQQLSLVKALESMKADHSSDGFQAIASFHALPPLCPSPAASKRFACCVHGMATFPQWHRLYTVQFQDSLRKHGAVVGLPYWDWTLPRSELPELLTVSTIHDPETGRDIPNPFIGSKIEFEGENVHTKRDINRDRLFQGSTKTHHNWFIEQALLALEQTNYCDFEVQFEIMHNGVHTWVGGKEPYGIGHLHYASYDPLFYIHHSQTDRIWAIWQSLQRFRGLSGSEANCAVNLMKTPLKPFSFGAPYNLNDHTHDFSKPEDTFDYQKFGYIYDTLEFAGWSIRGIDHIVRNRQEHSRVFAGFLLEGFGTSATVDFQVCRTAGDCEDAGYFTVLGGEKEMPWAFDRLYKYDITETLDKMNLRHDEIFQIEVTITSYDGTVLDSGLIPTPSIIYDPAHHDISSHHLSLNKVRHDLSTLSERDIGSLKYALSSLQADTSADGFAAIASFHGLPAKCNDSHNNEVACCIHGMPTFPHWHRLYTLQFEQALRRHGSSVAVPYWDWTKPIHNIPHLFTDKEYYDVWRNKVMPNPFARGYVPSHDTYTVRDVQEGLFHLTSTGEHSALLNQALLALEQHDYCDFAVQFEVMHNTIHYLVGGPQVYSLSSLHYASYDPIFFIHHSFVDKVWAVWQALQEKRGLPSDRADCAVSLMTQNMRPFHYEINHNQFTKKHAVPNDVFKYELLGYRYDNLEIGGMNLHEIEKEIKDKQHHVRVFAGFLLHGIRTSADVQFQICKTSEDCHHGGQIFVLGGTKEMAWAYNRLFKYDITHALHDAHITPEDVFHPSEPFFIKVSVTAVNGTVLPASILHAPTIIYEPGLGDHHEDHHSSSMAGHGVRKEINTLTTAEVDNLKDAMRAVMADHGPNGYQAIAAFHGNPPMCPMPDGKNYSCCTHGMATFPHWHRLYTKQMEDALTAHGARVGLPYWDGTTAFTALPTFVTDEEDNPFHHGHIDYLGVDTTRSPRDKLFNDPERGSESFFYRQVLLALEQTDFCQFEVQFEITHNAIHSWTGGLTPYGMSTLEYTTYDPLFWLHHANTDRIWAIWQALQEYRGLPYDHANCEIQAMKRPLRPFSDPINHNAFTHSNAKPTDVFEYSRFNFQYDNLRFHGMTIKKLEHELEKQKEEDRTFAAFLLHGIKKSADVSFDVCNHDGECHFAGTFAILGGEHEMPWSFDRLFRYDITQVLKQMHLEYDSDFTFHMRIIDTSGKQLPSDLIKMPTVEHSPGGKHHEKHHEDHHEDILVRKNIHSLSHHEAEELRDALYKLQNDESHGGYEHIAGFHGYPNLCPEKGDEKYPCCVHGMSIFPHWHRLHTIQFERALKKHGSHLGIPYWDWTQTISSLPTFFADSGNNNPFFKYHIRSINQDTVRDVNEAIFQQTKFGEFSSIFYLALQALEEDNYCDFEVQYEILHNEVHALIGGAEKYSMSTLEYSAFDPYFMIHHASLDKIWIIWQELQKRRVKPAHAGSCAGDIMHVPLHPFNYESVNNDDFTRENSLPNAVVDSHRFNYKYDNLNLHGHNIEELEEVLRSLRLKSRVFAGFVLSGIRTTAVVKVYIKSGTDSDDEYAGSFVILGGAKEMPWAYERLYRFDITETVHNLNLTDDHVKFRFDLKKYDHTELDASVLPAPIIVRRPNNAVFDIIEIPIGKDVNLPPKVVVKRGTKIMFMSVDEAVTTPMLNLGSYTAMFKCKVPPFSFHAFELGKMYSVESGDYFMTASTTELCNDNNLRIHVHVDDE

SEQ ID NO: 2 - protein, 3421 aa, Megathura crenulata
MWTILALLTATLLFEGAFSVDTVVRKNVDSLSSDEVLALEKALDDLQQDDSNQGYQAIAGYHGVPTMCVDKHEKNVACCLHGMPSFPLWHRLYVVQLERALIRKKATISIPYWDWTSELTHLPELVSHPLFVGTEGGKAHDNSWYRADITFLNKKTSRAVDDRLFEKVQPGHHTRLMEGILDALEQDEFCKFEIQFELAHNAIHYLVGGRHTYSMSHLEYTSYDPLFFLHHSNTDRIFAIWQRLQQLRGKDPNSADCAHNLIHTPMEPFDRDTNPLDLTREHAKPADSFDYGRLGYQYDDLSLNGMSPEELNVYLGERAAKERTFASFILSGFGGSANVVVYVCRPAHDEISDDQCIKAGDFFLLGGPTEMKWGFYRAYHFDVTDSVASIDDDGHGHYYVKSELFSVNGSALSNDILRQPTLVHRPAKGHFDKPPVPVAQANLAVRKNINDLTAEETYSLRKAMERFQNDKSVDGYQATVEFHALPARCPRPDAKDRFACCVHGMATFPHWHRLFVTQVEDALLRRGSTIGLPNWDWTMPMDHLPELATSETYLDPVTGETKNNPFHHAQVAFENGVTSRNPDAKLFMKPTYGDHTYLFDSMIYAFEQEDFCDFEVQYELTHNAIHAWVGGSEKYSMSSLHYTAFDPIFYLHHSNVDRLWAIWQALQIRRGKSYKAHCASSQEREPLKPFAFSSPLNNNEKTYHNSVPTNVYDYVGVLHYRYDDLQFGGMTMSELEEYIHKQTQHDRTFAGFFLSYIGTSASVDIFINREGHDKYKVGSFVVLGGSKEMKWGFDRMYKYEITEALKTLNVAVDDGFSITVEITDVDGSPPSADLIPPPAIIFERADAKDFGHSRKIRKAVDSLTVEEQTSLRRAMADLQDDKTSGGFQQIAAFHGEPKWCPSPEAEKKFACCVHGMAVFPHWHRLLTVQGENALRKHGFTGGLPYWDWTRSMSALPHFVADPTYNDAISSQEEDNPWHHGHIDSVGHDTTRDVRDDLYQSPGFGHYTDIAKQVLLAFEQDDFCDFEVQFEIAHNFIHALVGGNEPYSMSSLRYTTYDPIFFLHRSNTDRLWAIWQALQKYRGKPYNTANCAIASMRKPLQPFGLDSVINPDDETREHSVPFRVFDYKNNFDYEYESLAFNGLSIAQLDRELQRRKSHDRVFAGFLLHEIGQSALVKFYVCKHNVSDCDHYAGEFYILGDEAEMPWRYDRVYKYEITQQLHDLDLHVGDNFFLKYEAFDLNGGSLGGSIFSQPSVIFEPAAGSHQADEYREAVTSASHIRKNIRDLSEGEIESIRSAFLQIQKEGIYENIAKFHGKPGLCEHDGHPVACCVHGMPTFPHWHRLYVLQVENALLERGSAVAVPYWDWTEKADSLPSLINDATYFNSRSQTFDPNPFFRGHIAFENAVTSRDPQPELWDNKDFYENVMLALEQDNFCDFEIQLELIHNALHSRLGGRAKYSLSSLDYTAFDPVFFLHHANVDRIWAIWQDLQRYRKKPYNEADCAVNEMRKPLQPFNNPELNSDSMTLKHNLPQDSFDYQNRFRYQYDNLQFNHFSIQKLDQTIQARKQHDRVFAGFILHNIGTSAVVDIYICVEQGGEQNCKTKAGSFTILGGETEMPFHFDRLYKFDITSALHKLGVPLDGHGFDIKVDVRAVNGSHLDQHILNEPSLLFVPGERKNIYYDGLSQHNLVRKEVSSLTTLEKHFLRKALKNMQADDSPDGYQAIASFHALPPLCPSPSAAHRHACCLHGMATFPQWHRLYTVQFEDSLKRHGSIVGLPYWDWLKPQSALPDLVTQETYEHLFSHKTFPNPFLKANIEFEGEGVTTERDVDAEHLFAKGNLVYNNWFCNQALYALEQENYCDFEIQFEILHNGIHSWVGGSKTHSIGHLHYASYDPLFYIHHSQTDRIWAIWQALQEHRGLSGKEAHCALEQMKDPLKPFSFGSPYNLNKRTQEFSKPEDTFDYHRFGYEYDSLEFVGMSVSSLHNYIKQQQEADRVFAGFLLKGFGQSASVSFDICRPDQSCQEAGYFSVLGGSSEMPWQFDRLYKYDITKTLKDMKLRYDDTFTIKVHIKDIAGAELDSDLIPTPSVLLEEGKHGINVRHVGRNRIRMELSELTERDLASLKSAMRSLQADDGVNGYQAIASFHGLPASCHDDEGHEIACCIHGMPVFPHWHRLYTLQMDMALLSHGSAVAIPYWDWTKPISKLPDLFTSPEYYDPWRDAVVNNPFAKGYIKSEDAYTVRDPQDILYHLQDETGTSVLLDQTLLALEQTDFCDFEVQFEVVHNAIHYLVGGRQVYALSSQHYASYDPAFFIHHSFVDKIWAVWQALQKKRKRPYHKADCALNMMTKPMRPFAHDFNHNGFTKMHAVPNTLFDFQDLFYTYDNLEIAGMNVNQLEAEINRRKSQTRVFAGFLLHGIGRSADVRFWICKTADDCHASGMIFILGGSKEMHWAYDRNFKYDITQALKAQSIHPEDVFDTDAPFFIKVEVHGVNKTALPSSAIPAPTIIYSAGEGHTDDHGSDHIAGSGVRKDVTSLTASEIENLRHALQSVMDDDGPNGFQAIAAYHGSPPMCHMHDGRDVACCTHGMASFPHWHRLFVKQMEDALAAHGAHIGIPYWDWTSAFSHLPALVTDHEHNPFHHGHIAHRNVDTSRSPRDMLFNDPEHGSESFFYRQVLLALEQTDFCQFEVQFEITHNAIHSWTGGHTPYGMSSLEYTAYDPLFYLHHSNTDRIWAIWQALQKYRGFQYNAAHCDIQVLKQPLKPFSESRNPNPVTRANSRAVDSFDYERLNYQYDTLTFHGHSISELDAMLQERKKEERTFAAFLLHGFGASADVSFDVCTPDGHCAFAGTFAVLGGELEMPWSFERLFRYDITKVLKQMNLHYDSEFHFELKIVGTDGTELPSDRIKSPTIEHHGGDHHGGDTSGHDHSERHDGFFRKEVGSLSLDEANDLKNALYKLQNDQGPNGYESIAGYHGYPFLCPEHGEDQYACCVHGMPVFPHWHRLHTIQFERALKEHGSHLGIPYWDWTKSMIALPAFFADSSNSNPFYKYHIMKAGHDTARSPSDLLFNQPQLHGYDYLYYLALSTLEEDNYCDFEVHYEILHNAVHLWLGGTETYSMSSLAFSAYDPVFMILHSGLDRLWIIWQELQKLRKKPYNAAKCAGHMMDEPLHPFNYESANHDSFTRANAKPSTVFDSHKFNYHYDNPDVRGNSIQEISAIIHDLRNQPRVFAGFVLSGIYTSANVKIYLVREGHDDENVGSFVVLGGPKEMPWAYERIFKYDITEVANRLNMHHDDTFNFRLEVQSYTGEMVTHHLPEPLIIYRPAKQEYDVLVIPLGSGHKLPPKVIVKRGTRIMFHPVDDTVNRPVVDLGSHTALYNCVVPPFTYNGYELDHAYSLRDGHYYIAGPTKDLCTSGNVRIHIHIEDE

SEQ ID NO: 3 - protein, 8 aa, Artificial Sequence
  Description of Artificial Sequence: Synthetic peptide
KNINDLTR

SEQ ID NO: 4 - protein, 10 aa, Artificial Sequence
  Description of Artificial Sequence: Synthetic peptide
EAFHKFQEDR

SEQ ID NO: 5 - protein, 19 aa, Artificial Sequence
  Description of Artificial Sequence: Synthetic peptide
EDKSAGGFQQLGAFHGEPK

SEQ ID NO: 6 - protein, 20 aa, Artificial Sequence
  Description of Artificial Sequence: Synthetic peptide
SVQNKLFEQPEFGHYTSIAK

SEQ ID NO: 7 - protein, 13 aa, Artificial Sequence
  Description of Artificial Sequence: Synthetic peptide
DLFKQPSVIHEPR

SEQ ID NO: 8 - protein, 15 aa, Artificial Sequence
  Description of Artificial Sequence: Synthetic peptide
KNIENLSLGELESLR

SEQ ID NO: 9 - protein, 23 aa, Artificial Sequence
  Description of Artificial Sequence: Synthetic peptide
QHHYETNPFHHGKITHENEITTR

SEQ ID NO: 10 - protein, 17 aa, Artificial Sequence
  Description of Artificial Sequence: Synthetic peptide
KHGAVVGLPYWDWTLPR

SEQ ID NO: 11 - protein, 10 aa, Artificial Sequence
  Description of Artificial Sequence: Synthetic peptide
NKVMPNPFAR

SEQ ID NO: 12 - protein, 9 aa, Artificial Sequence
  Description of Artificial Sequence: Synthetic peptide
DKLFNDPER

SEQ ID NO: 13 - protein, 33 aa, Artificial Sequence
  Description of Artificial Sequence: Synthetic polypeptide
VKPAHAGSCAGDIMHVPLHPFNYESVNNDDFTR

SEQ ID NO: 14 - protein, 23 aa, Artificial Sequence
  Description of Artificial Sequence: Synthetic peptide
FNYKYDNLNLHGHNIEELEEVLR

SEQ ID NO: 15 - protein, 19 aa, Artificial Sequence
  Description of Artificial Sequence: Synthetic peptide
KYDHTELDASVLPAPIIVR

SEQ ID NO: 16 - protein, 14 aa, Artificial Sequence
  Description of Artificial Sequence: Synthetic peptide
ASKKFACCVHGMSV

SEQ ID NO: 17 - protein, 16 aa, Artificial Sequence
  Description of Artificial Sequence: Synthetic peptide
KNVDSLSSDEVLALEK

SEQ ID NO: 18 - protein, 12 aa, Artificial Sequence
  Description of Artificial Sequence: Synthetic peptide
LFEKVQPGHHTR

SEQ ID NO: 19 - protein, 23 aa, Artificial Sequence
  Description of Artificial Sequence: Synthetic peptide
GKDPNSADCAHNLIHTPMEPFDR

SEQ ID NO: 20 - protein, 13 aa, Artificial Sequence
  Description of Artificial Sequence: Synthetic peptide
EHAKPADSFDYGR

SEQ ID NO: 21 - protein, 28 aa, Artificial Sequence
  Description of Artificial Sequence: Synthetic peptide
QPTLVHRPAKGHFDKPPVPVAQANLAVR

SEQ ID NO: 22 - protein, 26 aa, Artificial Sequence
  Description of Artificial Sequence: Synthetic peptide
AMERFQNDKSVDGYQATVEFHALPAR

SEQ ID NO: 23 - protein, 19 aa, Artificial Sequence
  Description of Artificial Sequence: Synthetic peptide
KPLQPFGLDSVINPDDETR

SEQ ID NO: 24 - protein, 27 aa, Artificial Sequence
  Description of Artificial Sequence: Synthetic peptide
VFDYKNNFDYEYESLAFNGLSIAQLDR

SEQ ID NO: 25 - protein, 31 aa, Artificial Sequence
  Description of Artificial Sequence: Synthetic polypeptide
GSAVAVPYWDWTEKADSLPSLINDATYFNSR

SEQ ID NO: 26 - protein, 26 aa, Artificial Sequence
  Description of Artificial Sequence: Synthetic peptide
AKYSLSSLDYTAFDPVFFLHHANVDR

SEQ ID NO: 27 - protein, 32 aa, Artificial Sequence
  Description of Artificial Sequence: Synthetic polypeptide
KPLQPFNNPELNSDSMTLKHNLPQDSFDYQNR

SEQ ID NO: 28 - protein, 15 aa, Artificial Sequence
  Description of Artificial Sequence: Synthetic peptide
TQEFSKPEDTFDYHR

SEQ ID NO: 29 - protein, 12 aa, Artificial Sequence
  Description of Artificial Sequence: Synthetic peptide
SIRSAFLQIQKE

SEQ ID NO: 30 - protein, 11 aa, Artificial Sequence
  Description of Artificial Sequence: Synthetic peptide
GLSQHNLVRKE

SEQ ID NO: 31 - protein, 18 aa, Artificial Sequence
  Description of Artificial Sequence: Synthetic peptide
ICVEQGGEQNCKTKAGSF

SEQ ID NO: 32 - protein, 11 aa, Artificial Sequence
  Description of Artificial Sequence: Synthetic peptide
IKQQQEADRVF

SEQ ID NO: 33 - protein, 19 aa, Artificial Sequence
  Description of Artificial Sequence: Synthetic peptide
EDKSAGGFQQLGAFHGEPK

SEQ ID NO: 34 - protein, 20 aa, Artificial Sequence
  Description of Artificial Sequence: Synthetic peptide
SVQNKLFEQPEFGHYTSIAK

SEQ ID NO: 35 - protein, 13 aa, Artificial Sequence
  Description of Artificial Sequence: Synthetic peptide
DLFKQPSVIHEPR

SEQ ID NO: 36 - protein, 23 aa, Artificial Sequence
  Description of Artificial Sequence: Synthetic peptide
QHHYETNPFHHGKITHENEITTR

SEQ ID NO: 37 - protein, 10 aa, Artificial Sequence
  Description of Artificial Sequence: Synthetic peptide
NKVMPNPFAR

SEQ ID NO: 38 - protein, 19 aa, Artificial Sequence
  Description of Artificial Sequence: Synthetic peptide
KEINTLTTAEVDNLKDAMR

SEQ ID NO: 39 - protein, 33 aa, Artificial Sequence; identical to SEQ ID NO: 13
  Description of Artificial Sequence: Synthetic polypeptide

SEQ ID NO: 40 - protein, 12 aa, Artificial Sequence
  Description of Artificial Sequence: Synthetic peptide
AFHKFQEDRSVD

SEQ ID NO: 41 - protein, 7 aa, Artificial Sequence
  Description of Artificial Sequence: Synthetic peptide
VQHKAGT

SEQ ID NO: 42 - protein, 16 aa, Artificial Sequence
  Description of Artificial Sequence: Synthetic peptide
KNVDSLSSDEVLALEK

SEQ ID NO: 43 - protein, 12 aa, Artificial Sequence
  Description of Artificial Sequence: Synthetic peptide
LFEKVQPGHHTR

SEQ ID NO: 44 - protein, 32 aa, Artificial Sequence
  Description of Artificial Sequence: Synthetic polypeptide
GKDPNSADCAHNLIHTPMEPFDRDTNPLDLTR

SEQ ID NO: 45 - protein, 13 aa, Artificial Sequence
  Description of Artificial Sequence: Synthetic peptide
EHAKPADSFDYGR

SEQ ID NO: 46 - protein, 22 aa, Artificial Sequence
  Description of Artificial Sequence: Synthetic peptide
FQNDKSVDGYQATVEFHALPAR

SEQ ID NO: 47 - protein, 19 aa, Artificial Sequence
  Description of Artificial Sequence: Synthetic peptide
KPLQPFGLDSVINPDDETR

SEQ ID NO: 48 - protein, 27 aa, Artificial Sequence
  Description of Artificial Sequence: Synthetic peptide
VFDYKNNFDYEYESLAFNGLSIAQLDR

SEQ ID NO: 49 - protein, 26 aa, Artificial Sequence
  Description of Artificial Sequence: Synthetic peptide
AKYSLSSLDYTAFDPVFFLHHANVDR

SEQ ID NO: 50 - protein, 32 aa, Artificial Sequence; identical to SEQ ID NO: 27
  Description of Artificial Sequence: Synthetic polypeptide

SEQ ID NO: 51 - protein, 15 aa, Artificial Sequence
  Description of Artificial Sequence: Synthetic peptide
TQEFSKPEDTFDYHR

SEQ ID NO: 52 - protein, 11 aa, Artificial Sequence
  Description of Artificial Sequence: Synthetic peptide
IKQQQEADRVF

SEQ ID NO: 53 - protein, 17 aa, Artificial Sequence
  Description of Artificial Sequence: Synthetic peptide
KAQSIHPEDVFDTDAPF

SEQ ID NO: 54 - protein, 26 aa, Artificial Sequence
  Description of Artificial Sequence: Synthetic peptide
AHCAISLEHMHLKPFAFSSPLNNNEK

SEQ ID NO: 55 - protein, 23 aa, Artificial Sequence
  Description of Artificial Sequence: Synthetic peptide
QHHYETNPFHHGKITHENEITTR

SEQ ID NO: 56 - protein, 23 aa, Artificial Sequence
  Description of Artificial Sequence: Synthetic peptide
QHHYETNPFHHGKITHENEITTR

SEQ ID NO: 57 - protein, 19 aa, Artificial Sequence
  Description of Artificial Sequence: Synthetic peptide
KEINTLTTAEVDNLKDAMR

SEQ ID NO: 58 - protein, 33 aa, Artificial Sequence; identical to SEQ ID NO: 13
  Description of Artificial Sequence: Synthetic polypeptide

SEQ ID NO: 59 - protein, 19 aa, Artificial Sequence
  Description of Artificial Sequence: Synthetic peptide
KPLQPFGLDSVINPDDETR

SEQ ID NO: 60 - protein, 31 aa, Artificial Sequence; identical to SEQ ID NO: 25
  Description of Artificial Sequence: Synthetic polypeptide

SEQ ID NO: 61 - protein, 32 aa, Artificial Sequence; identical to SEQ ID NO: 27
  Description of Artificial Sequence: Synthetic polypeptide

SEQ ID NO: 62 - protein, 15 aa, Artificial Sequence
  Description of Artificial Sequence: Synthetic peptide
TQEFSKPEDTFDYHR

SEQ ID NO: 63 - protein, 17 aa, Artificial Sequence
  Description of Artificial Sequence: Synthetic peptide
KAQSIHPEDVFDTDAPF

SEQ ID NO: 64 - protein, 10 aa, Artificial Sequence
  Description of Artificial Sequence: Synthetic peptide
FILGGSKEMH

SEQ ID NO: 65 - protein, 26 aa, Artificial Sequence
  Description of Artificial Sequence: Synthetic peptide
AHCAISLEHMHLKPFAFSSPLNNNEK

SEQ ID NO: 66 - protein, 13 aa, Artificial Sequence
  Description of Artificial Sequence: Synthetic peptide
DLFKQPSVIHEPR

SEQ ID NO: 67 - protein, 23 aa, Artificial Sequence
  Description of Artificial Sequence: Synthetic peptide
QHHYETNPFHHGKITHENEITTR

SEQ ID NO: 68 - protein, 10 aa, Artificial Sequence
  Description of Artificial Sequence: Synthetic peptide
NKVMPNPFAR

SEQ ID NO: 69 - protein, 19 aa, Artificial Sequence
  Description of Artificial Sequence: Synthetic peptide
KEINTLTTAEVDNLKDAMR

SEQ ID NO: 70 - protein, 9 aa, Artificial Sequence
  Description of Artificial Sequence: Synthetic peptide
DKLFNDPER

SEQ ID NO: 71 - protein, 33 aa, Artificial Sequence; identical to SEQ ID NO: 13
  Description of Artificial Sequence: Synthetic polypeptide

SEQ ID NO: 72 - protein, 7 aa, Artificial Sequence
  Description of Artificial Sequence: Synthetic peptide
LKDLDLT

SEQ ID NO: 73 - protein, 12 aa, Artificial Sequence
  Description of Artificial Sequence: Synthetic peptide
LFEKVQPGHHTR

SEQ ID NO: 74 - protein, 23 aa, Artificial Sequence
  Description of Artificial Sequence: Synthetic peptide
GKDPNSADCAHNLIHTPMEPFDR

SEQ ID NO: 75 - protein, 13 aa, Artificial Sequence
  Description of Artificial Sequence: Synthetic peptide
EHAKPADSFDYGR

SEQ ID NO: 76 - protein, 28 aa, Artificial Sequence
  Description of Artificial Sequence: Synthetic peptide
QPTLVHRPAKGHFDKPPVPVAQANLAVR

SEQ ID NO: 77 - protein, 22 aa, Artificial Sequence
  Description of Artificial Sequence: Synthetic peptide
FQNDKSVDGYQATVEFHALPAR

SEQ ID NO: 78 - protein, 19 aa, Artificial Sequence
  Description of Artificial Sequence: Synthetic peptide
KPLQPFGLDSVINPDDETR

SEQ ID NO: 79 - protein, 15 aa, Artificial Sequence
  Description of Artificial Sequence: Synthetic peptide
TQEFSKPEDTFDYHR

SEQ ID NO: 80 - protein, 11 aa, Artificial Sequence
  Description of Artificial Sequence: Synthetic peptide
IKQQQEADRVF

SEQ ID NO: 81 - protein, 17 aa, Artificial Sequence
  Description of Artificial Sequence: Synthetic peptide
KAQSIHPEDVFDTDAPF

SEQ ID NO: 82 - protein, 15 aa, Artificial Sequence
  Description of Artificial Sequence: Synthetic peptide
LKHNLPQDSFDYQNR

SEQ ID NO: 83 - protein, 12 aa, Artificial Sequence
  Description of Artificial Sequence: Synthetic peptide
FSKPEDTFDYHR

SEQ ID NO: 84 - protein, 19 aa, Artificial Sequence
  Description of Artificial Sequence: Synthetic peptide
EDKSAGGFQQLGAFHGEPK

SEQ ID NO: 85 - protein, 20 aa, Artificial Sequence
  Description of Artificial Sequence: Synthetic peptide
SVQNKLFEQPEFGHYTSIAK

SEQ ID NO: 86 - protein, 13 aa, Artificial Sequence
  Description of Artificial Sequence: Synthetic peptide
DLFKQPSVIHEPR

SEQ ID NO: 87 - protein, 23 aa, Artificial Sequence
  Description of Artificial Sequence: Synthetic peptide
QHHYETNPFHHGKITHENEITTR

SEQ ID NO: 88 - protein, 29 aa, Artificial Sequence
  Description of Artificial Sequence: Synthetic peptide
ADHSSDGFQAIASFHALPPLCPSPAASKR

SEQ ID NO: 89 - protein, 17 aa, Artificial Sequence
  Description of Artificial Sequence: Synthetic peptide
KHGAVVGLPYWDWTLPR

SEQ ID NO: 90 - protein, 10 aa, Artificial Sequence
  Description of Artificial Sequence: Synthetic peptide
NKVMPNPFAR

SEQ ID NO: 91 - protein, 19 aa, Artificial Sequence
  Description of Artificial Sequence: Synthetic peptide
KEINTLTTAEVDNLKDAMR

SEQ ID NO: 92 - protein, 9 aa, Artificial Sequence
  Description of Artificial Sequence: Synthetic peptide
DKLFNDPER

SEQ ID NO: 93 - protein, 33 aa, Artificial Sequence; identical to SEQ ID NO: 13
  Description of Artificial Sequence: Synthetic polypeptide

SEQ ID NO: 94 - protein, 23 aa, Artificial Sequence
  Description of Artificial Sequence: Synthetic peptide
FNYKYDNLNLHGHNIEELEEVLR

SEQ ID NO: 95 - protein, 19 aa, Artificial Sequence
  Description of Artificial Sequence: Synthetic peptide
KYDHTELDASVLPAPIIVR

SEQ ID NO: 96 - protein, 12 aa, Artificial Sequence
  Description of Artificial Sequence: Synthetic peptide
AFHKFQEDRSVD

SEQ ID NO: 97 - protein, 16 aa, Artificial Sequence
  Description of Artificial Sequence: Synthetic peptide
KNVDSLSSDEVLALEK

SEQ ID NO: 98 - protein, 12 aa, Artificial Sequence
  Description of Artificial Sequence: Synthetic peptide
LFEKVQPGHHTR

SEQ ID NO: 99 - protein, 13 aa, Artificial Sequence
  Description of Artificial Sequence: Synthetic peptide
EHAKPADSFDYGR

SEQ ID NO: 100 - protein, 28 aa, Artificial Sequence
  Description of Artificial Sequence: Synthetic peptide
QPTLVHRPAKGHFDKPPVPVAQANLAVR

SEQ ID NO: 101 - protein, 22 aa, Artificial Sequence
  Description of Artificial Sequence: Synthetic peptide
FQNDKSVDGYQATVEFHALPAR

SEQ ID NO: 102 - protein, 15 aa, Artificial Sequence
  Description of Artificial Sequence: Synthetic peptide
KHGFTGGLPYWDWTR

SEQ ID NO: 103 - protein, 19 aa, Artificial Sequence
  Description of Artificial Sequence: Synthetic peptide
KPLQPFGLDSVINPDDETR

SEQ ID NO: 104 - protein, 26 aa, Artificial Sequence
  Description of Artificial Sequence: Synthetic peptide
AKYSLSSLDYTAFDPVFFLHHANVDR

SEQ ID NO: 105 - protein, 32 aa, Artificial Sequence; identical to SEQ ID NO: 27
  Description of Artificial Sequence: Synthetic polypeptide

SEQ ID NO: 106 - protein, 15 aa, Artificial Sequence
  Description of Artificial Sequence: Synthetic peptide
TQEFSKPEDTFDYHR

SEQ ID NO: 107 - protein, 15 aa, Artificial Sequence
  Description of Artificial Sequence: Synthetic peptide
KDVTSLTASEIENLR

SEQ ID NO: 108 - protein, 18 aa, Artificial Sequence
  Description of Artificial Sequence: Synthetic peptide
ALKEHGSHLGIPYWDWTK

SEQ ID NO: 109 - protein, 12 aa, Artificial Sequence
  Description of Artificial Sequence: Synthetic peptide
SIRSAFLQIQKE

SEQ ID NO: 110 - protein, 17 aa, Artificial Sequence
  Description of Artificial Sequence: Synthetic peptide
KAQSIHPEDVFDTDAPF

SEQ ID NO: 111 - protein, 7 aa, Artificial Sequence
  Description of Artificial Sequence: Synthetic peptide
IQKLDQT

SEQ ID NO: 112 - protein, 13 aa, Artificial Sequence
  Description of Artificial Sequence: Synthetic peptide
DLFKQPSVIHEPR

SEQ ID NO: 113 - protein, 23 aa, Artificial Sequence
  Description of Artificial Sequence: Synthetic peptide
QHHYETNPFHHGKITHENEITTR

SEQ ID NO: 114 - protein, 29 aa, Artificial Sequence
  Description of Artificial Sequence: Synthetic peptide
ADHSSDGFQAIASFHALPPLCPSPAASKR

SEQ ID NO: 115 - protein, 19 aa, Artificial Sequence
  Description of Artificial Sequence: Synthetic peptide
KEINTLTTAEVDNLKDAMR

SEQ ID NO: 116 - protein, 9 aa, Artificial Sequence
  Description of Artificial Sequence: Synthetic peptide
DKLFNDPER

SEQ ID NO: 117 - protein, 33 aa, Artificial Sequence; identical to SEQ ID NO: 13
  Description of Artificial Sequence: Synthetic polypeptide

SEQ ID NO: 118 - protein, 16 aa, Artificial Sequence
  Description of Artificial Sequence: Synthetic peptide
NLNDHTHDFSKPEDTF

SEQ ID NO: 119 - protein, 16 aa, Artificial Sequence
  Description of Artificial Sequence: Synthetic peptide
KNVDSLSSDEVLALEK

SEQ ID NO: 120 - protein, 12 aa, Artificial Sequence
  Description of Artificial Sequence: Synthetic peptide
LFEKVQPGHHTR

SEQ ID NO: 121 - protein, 23 aa, Artificial Sequence
  Description of Artificial Sequence: Synthetic peptide
GKDPNSADCAHNLIHTPMEPFDR

SEQ ID NO: 122 - protein, 13 aa, Artificial Sequence
  Description of Artificial Sequence: Synthetic peptide
EHAKPADSFDYGR

SEQ ID NO: 123 - protein, 28 aa, Artificial Sequence
  Description of Artificial Sequence: Synthetic peptide
QPTLVHRPAKGHFDKPPVPVAQANLAVR

SEQ ID NO: 124 - protein, 22 aa, Artificial Sequence
  Description of Artificial Sequence: Synthetic peptide
FQNDKSVDGYQATVEFHALPAR

SEQ ID NO: 125 - protein, 19 aa, Artificial Sequence
  Description of Artificial Sequence: Synthetic peptide
KPLQPFGLDSVINPDDETR

SEQ ID NO: 126 - protein, 31 aa, Artificial Sequence; identical to SEQ ID NO: 25
  Description of Artificial Sequence: Synthetic polypeptide

SEQ ID NO: 127 - protein, 19 aa, Artificial Sequence
  Description of Artificial Sequence: Synthetic peptide
KPLQPFNNPELNSDSMTLK

SEQ ID NO: 128 - protein, 15 aa, Artificial Sequence
  Description of Artificial Sequence: Synthetic peptide
TQEFSKPEDTFDYHR

SEQ ID NO: 129 - protein, 15 aa, Artificial Sequence
  Description of Artificial Sequence: Synthetic peptide
KDVTSLTASEIENLR

SEQ ID NO: 130 - protein, 12 aa, Artificial Sequence
  Description of Artificial Sequence: Synthetic peptide
SIRSAFLQIQKE

SEQ ID NO: 131 - protein, 15 aa, Artificial Sequence
  Description of Artificial Sequence: Synthetic peptide
KHNLPQDSFDYQNRF

SEQ ID NO: 132 - protein, 11 aa, Artificial Sequence
  Description of Artificial Sequence: Synthetic peptide
IKQQQEADRVF

SEQ ID NO: 133 - protein, 17 aa, Artificial Sequence
  Description of Artificial Sequence: Synthetic peptide
KAQSIHPEDVFDTDAPF

SEQ ID NO: 134 - protein, 26 aa, Artificial Sequence
  Description of Artificial Sequence: Synthetic peptide
AHCAISLEHMHLKPFAFSSPLNNNEK

SEQ ID NO: 135 - protein, 20 aa, Artificial Sequence
  Description of Artificial Sequence: Synthetic peptide
SVQNKLFEQPEFGHYTSIAK

SEQ ID NO: 136 - protein, 23 aa, Artificial Sequence
  Description of Artificial Sequence: Synthetic peptide
QHHYETNPFHHGKITHENEITTR

SEQ ID NO: 137 - protein, 19 aa, Artificial Sequence
  Description of Artificial Sequence: Synthetic peptide
KEINTLTTAEVDNLKDAMR

SEQ ID NO: 138 - protein, 33 aa, Artificial Sequence; identical to SEQ ID NO: 13
  Description of Artificial Sequence: Synthetic polypeptide

SEQ ID NO: 139 - protein, 12 aa, Artificial Sequence
  Description of Artificial Sequence: Synthetic peptide
AFHKFQEDRSVD

SEQ ID NO: 140 - protein, 28 aa, Artificial Sequence
  Description of Artificial Sequence: Synthetic peptide
QPTLVHRPAKGHFDKPPVPVAQANLAVR

SEQ ID NO: 141 - protein, 19 aa, Artificial Sequence
  Description of Artificial Sequence: Synthetic peptide
KPLQPFGLDSVINPDDETR

SEQ ID NO: 142 - protein, 31 aa, Artificial Sequence; identical to SEQ ID NO: 25
  Description of Artificial Sequence: Synthetic polypeptide

SEQ ID NO: 143 - protein, 32 aa, Artificial Sequence; identical to SEQ ID NO: 27
  Description of Artificial Sequence: Synthetic polypeptide

SEQ ID NO: 144 - protein, 12 aa, Artificial Sequence
  Description of Artificial Sequence: Synthetic peptide
LHVGDNFFLKYE

SEQ ID NO: 145 - protein, 12 aa, Artificial Sequence
  Description of Artificial Sequence: Synthetic peptide
IWAIWQALQKYR

SEQ ID NO: 146 - protein, 13 aa, Artificial Sequence
  Description of Artificial Sequence: Synthetic peptide
DLFKQPSVIHEPR

SEQ ID NO: 147 - protein, 23 aa, Artificial Sequence
  Description of Artificial Sequence: Synthetic peptide
QHHYETNPFHHGKITHENEITTR

SEQ ID NO: 148 - protein, 10 aa, Artificial Sequence
  Description of Artificial Sequence: Synthetic peptide
NKVMPNPFAR

SEQ ID NO: 149 - protein, 19 aa, Artificial Sequence
  Description of Artificial Sequence: Synthetic peptide
KEINTLTTAEVDNLKDAMR

SEQ ID NO: 150 - protein, 33 aa, Artificial Sequence; identical to SEQ ID NO: 13
  Description of Artificial Sequence: Synthetic polypeptide

SEQ ID NO: 151 - protein, 16 aa, Artificial Sequence
  Description of Artificial Sequence: Synthetic peptide
NLNDHTHDFSKPEDTF

SEQ ID NO: 152 - protein, 12 aa, Artificial Sequence
  Description of Artificial Sequence: Synthetic peptide
FHGEPKWCPSPE

SEQ ID NO: 153 - protein, 8 aa, Artificial Sequence
  Description of Artificial Sequence: Synthetic peptide
VGGKEPYG

SEQ ID NO: 154 - protein, 12 aa, Artificial Sequence
  Description of Artificial Sequence: Synthetic peptide
LFEKVQPGHHTR

SEQ ID NO: 155 - protein, 13 aa, Artificial Sequence
  Description of Artificial Sequence: Synthetic peptide
EHAKPADSFDYGR

SEQ ID NO: 156 - protein, 22 aa, Artificial Sequence
  Description of Artificial Sequence: Synthetic peptide
FQNDKSVDGYQATVEFHALPAR

SEQ ID NO: 157 - protein, 19 aa, Artificial Sequence
  Description of Artificial Sequence: Synthetic peptide
KPLQPFGLDSVINPDDETR

SEQ ID NO: 158 - protein, 15 aa, Artificial Sequence
  Description of Artificial Sequence: Synthetic peptide
TQEFSKPEDTFDYHR

SEQ ID NO: 159 - protein, 12 aa, Artificial Sequence
  Description of Artificial Sequence: Synthetic peptide
IWAIWQALQKYR

SEQ ID NO: 160 - protein, 11 aa, Artificial Sequence
  Description of Artificial Sequence: Synthetic peptide
IKQQQEADRVF

SEQ ID NO: 161 - protein, 17 aa, Artificial Sequence
  Description of Artificial Sequence: Synthetic peptide
KAQSIHPEDVFDTDAPF

SEQ ID NO: 162 - protein, 12 aa, Artificial Sequence
  Description of Artificial Sequence: Synthetic peptide
FHGEPKWCPSPE

SEQ ID NO: 163 - protein, 10 aa, Artificial Sequence
  Description of Artificial Sequence: Synthetic peptide
LHVGDNFFLK

SEQ ID NO: 164 - protein, 12 aa, Artificial Sequence
  Description of Artificial Sequence: Synthetic peptide
FSKPEDTFDYHR

SEQ ID NO: 165 - protein, 18 aa, Artificial Sequence
  Description of Artificial Sequence: Synthetic peptide
GFTDPPVKHHQSANLLVR

SEQ ID NO: 166 - protein, 10 aa, Artificial Sequence
  Description of Artificial Sequence: Synthetic peptide
EAFHKFQEDR

SEQ ID NO: 167 - protein, 26 aa, Artificial Sequence
  Description of Artificial Sequence: Synthetic peptide
AHCAISLEHMHLKPFAFSSPLNNNEK

SEQ ID NO: 168 - protein, 18 aa, Artificial Sequence
  Description of Artificial Sequence: Synthetic peptide
TSANVDIFIKTTDSVQHK

SEQ ID NO: 169 - protein, 19 aa, Artificial Sequence
  Description of Artificial Sequence: Synthetic peptide
TTDSVQHKAGTFAVLGGSK

SEQ ID NO: 170 - protein, 8 aa, Artificial Sequence
  Description of Artificial Sequence: Synthetic peptide
EMKWGFDR

SEQ ID NO: 171 - protein, 8 aa, Artificial Sequence
  Description of Artificial Sequence: Synthetic peptide
VKFDKVPR

SEQ ID NO: 172 - protein, 5 aa, Artificial Sequence
  Description of Artificial Sequence: Synthetic peptide
KNVDR

SEQ ID NO: 173 - protein, 7 aa, Artificial Sequence
  Description of Artificial Sequence: Synthetic peptide
KALALLK

SEQ ID NO: 174 - protein, 19 aa, Artificial Sequence
  Description of Artificial Sequence: Synthetic peptide
EDKSAGGFQQLGAFHGEPK

SEQ ID NO: 175 - protein, 25 aa, Artificial Sequence
  Description of Artificial Sequence: Synthetic peptide
SAGGFQQLGAFHGEPKWCPSPEASK

SEQ ID NO: 176 - protein, 37 aa, Artificial Sequence
  Description of Artificial Sequence: Synthetic polypeptide
HGYDGALPYWDWTSPLNHLPELADHEKYVDPEDGVEK

SEQ ID NO: 177 - protein, 18 aa, Artificial Sequence
  Description of Artificial Sequence: Synthetic peptide
HNPWFDGHIDTVDKTTTR

SEQ ID NO: 178 - protein, 20 aa, Artificial Sequence
  Description of Artificial Sequence: Synthetic peptide
SVQNKLFEQPEFGHYTSIAK

SEQ ID NO: 179 - protein, 12 aa, Artificial Sequence
  Description of Artificial Sequence: Synthetic peptide
IWAIWQALQKYR

SEQ ID NO: 180 - protein, 15 aa, Artificial Sequence
  Description of Artificial Sequence: Synthetic peptide
GKPYNVANCAVTSMR

SEQ ID NO: 181 - protein, 6 aa, Artificial Sequence
  Description of Artificial Sequence: Synthetic peptide
KLEAIK

SEQ ID NO: 182 - protein, 13 aa, Artificial Sequence
  Description of Artificial Sequence: Synthetic peptide
DLFKQPSVIHEPR

SEQ ID NO: 183 - protein, 15 aa, Artificial Sequence
  Description of Artificial Sequence: Synthetic peptide
KNIENLSLGELESLR

SEQ ID NO: 184 - protein, 13 aa, Artificial Sequence
  Description of Artificial Sequence: Synthetic peptide
LYVVVVENALLKK

SEQ ID NO: 185 - protein, 23 aa, Artificial Sequence
  Description of Artificial Sequence: Synthetic peptide
QHHYETNPFHHGKITHENEITTR

SEQ ID NO: 186 - protein, 45 aa, Artificial Sequence
  Description of Artificial Sequence: Synthetic polypeptide
DSLFHSDYFYEQVLYALEQDNFCDFEIQLEILHNALHSLLGGKGK

SEQ ID NO: 187 - protein, 5 aa, Artificial Sequence
  Description of Artificial Sequence: Synthetic peptide
KRPYR

SEQ ID NO: 188 - protein, 8 aa, Artificial Sequence
  Description of Artificial Sequence: Synthetic peptide
LDITKALK

SEQ ID NO: 189 - protein, 9 aa, Artificial Sequence
  Description of Artificial Sequence: Synthetic peptide
KDITQLDKR

SEQ ID NO: 190 - protein, 9 aa, Artificial Sequence
  Description of Artificial Sequence: Synthetic peptide
KDITQLDKR

SEQ ID NO: 191 - protein, 29 aa, Artificial Sequence
  Description of Artificial Sequence: Synthetic peptide
ADHSSDGFQAIASFHALPPLCPSPAASKR

SEQ ID NO: 192 - protein, 17 aa, Artificial Sequence
  Description of Artificial Sequence: Synthetic peptide
KHGAVVGLPYWDWTLPR

SEQ ID NO: 193 - protein, 12 aa, Artificial Sequence
  Description of Artificial Sequence: Synthetic peptide
IEFEGENVHTKR

SEQ ID NO: 194 - protein, 26 aa, Artificial Sequence
  Description of Artificial Sequence: Synthetic peptide
TAGDCEDAGYFTVLGGEKEMPWAFDR

SEQ ID NO: 195 - protein, 12 aa, Artificial Sequence
  Description of Artificial Sequence: Synthetic peptide
LYKYDITETLDK

SEQ ID NO: 196 - protein, 10 aa, Artificial Sequence
  Description of Artificial Sequence: Synthetic peptide
NKVMPNPFAR

SEQ ID NO: 197 - protein, 10 aa, Artificial Sequence
  Description of Artificial Sequence: Synthetic peptide
KHAVPNDVFK

SEQ ID NO: 198 - protein, 16 aa, Artificial Sequence
  Description of Artificial Sequence: Synthetic peptide
HAVPNDVFKYELLGYR

SEQ ID NO: 199 - protein, 29 aa, Artificial Sequence
  Description of Artificial Sequence: Synthetic peptide
TSADVQFQICKTSEDCHHGGQIFVLGGTK

SEQ ID NO: 200 - protein, 16 aa, Artificial Sequence
  Description of Artificial Sequence: Synthetic peptide
LYTKQMEDALTAHGAR

SEQ ID NO: 201 - protein, 9 aa, Artificial Sequence
  Description of Artificial Sequence: Synthetic peptide
DKLFNDPER

SEQ ID NO: 202 - protein, 30 aa, Artificial Sequence
  Description of Artificial Sequence: Synthetic polypeptide
RPLRPFSDPINHNAFTHSNAKPTDVFEYSR

SEQ ID NO: 203 - protein, 8 aa, Artificial Sequence
  Description of Artificial Sequence: Synthetic peptide
KLEHELEK

SEQ ID NO: 204 - protein, 6 aa, Artificial Sequence
  Description of Artificial Sequence: Synthetic peptide
QKEEDR

SEQ ID NO: 205 - protein, 15 aa, Artificial Sequence
  Description of Artificial Sequence: Synthetic peptide
IIDTSGKQLPSDLIK

SEQ ID NO: 206 - protein, 16 aa, Artificial Sequence
  Description of Artificial Sequence: Synthetic peptide
HHEKHHEDHHEDILVR

SEQ ID NO: 207 - protein, 15 aa, Artificial Sequence
  Description of Artificial Sequence: Synthetic peptide
KNIHSLSHHEAEELR

SEQ ID NO: 208 - protein, 31 aa, Artificial Sequence
  Description of Artificial Sequence: Synthetic polypeptide
DALYKLQNDESHGGYEHIAGFHGYPNLCPEK

SEQ ID NO: 209 - protein, 54 aa, Artificial Sequence
  Description of Artificial Sequence: Synthetic polypeptide
DVNEAIFQQTKFGEFSSIFYLALQALEEDNYCDFEVQYEILHNEVHALIGGAEK

SEQ ID NO: 210 - protein, 33 aa, Artificial Sequence; identical to SEQ ID NO: 13
  Description of Artificial Sequence: Synthetic polypeptide

SEQ ID NO: 211 - protein, 23 aa, Artificial Sequence
  Description of Artificial Sequence: Synthetic peptide
FNYKYDNLNLHGHNIEELEEVLR

SEQ ID NO: 212 - protein, 10 aa, Artificial Sequence
  Description of Artificial Sequence: Synthetic peptide
TTAVVKVYIK

SEQ ID NO: 213 - protein, 19 aa, Artificial Sequence
  Description of Artificial Sequence: Synthetic peptide
KYDHTELDASVLPAPIIVR

SEQ ID NO: 214 - protein, 23 aa, Artificial Sequence
  Description of Artificial Sequence: Synthetic peptide
RPNNAVFDIIEIPIGKDVNLPPK

SEQ ID NO: 215 - protein, 29 aa, Artificial Sequence
  Description of Artificial Sequence: Synthetic peptide
KGFTDPPVKHHQSANLLVRKNINDLTREE

SEQ ID NO: 216 - protein, 19 aa, Artificial Sequence
  Description of Artificial Sequence: Synthetic peptide
AFHKFQEDRSVDGYQATAE

SEQ ID NO: 217 - protein, 8 aa, Artificial Sequence
  Description of Artificial Sequence: Synthetic peptide
NIEKMIHE

SEQ ID NO: 218 - protein, 19 aa, Artificial Sequence
  Description of Artificial Sequence: Synthetic peptide
VDGTKLASSLIPHASVIRE

SEQ ID NO: 219 - protein, 24 aa, Artificial Sequence
  Description of Artificial Sequence: Synthetic peptide
DKSAGGFQQLGAFHGEPKWCPSPE

SEQ ID NO: 220 - protein, 24 aa, Artificial Sequence
  Description of Artificial Sequence: Synthetic peptide
DKSAGGFQQLGAFHGEPKWCPSPE

SEQ ID NO: 221 - protein, 16 aa, Artificial Sequence
  Description of Artificial Sequence: Synthetic peptide
FGHYTSIAKQVLLALE

SEQ ID NO: 222 - protein, 17 aa, Artificial Sequence
  Description of Artificial Sequence: Synthetic peptide
HSVPFNVFDYKTNFNYE

SEQ ID NO: 223 - protein, 14 aa, Artificial Sequence
  Description of Artificial Sequence: Synthetic peptide
FNGLSISQLNKKLE

SEQ ID NO: 224 - protein, 31 aa, Artificial Sequence
  Description of Artificial Sequence: Synthetic polypeptide
VFDLKPASLGKDLFKQPSVIHEPRIGHHEGE

SEQ ID NO: 225 - protein, 29 aa, Artificial Sequence
  Description of Artificial Sequence: Synthetic peptide
VFDLKPASLGKDLFKQPSVIHEPRIGHHE

SEQ ID NO: 226 - protein, 22 aa, Artificial Sequence
  Description of Artificial Sequence: Synthetic peptide
NALLKKGSSVAVPYWDWTKRIE

SEQ ID NO: 227 - protein, 22 aa, Artificial Sequence
  Description of Artificial Sequence: Synthetic peptide
NALLKKGSSVAVPYWDWTKRIE

SEQ ID NO: 228 - protein, 12 aa, Artificial Sequence
  Description of Artificial Sequence: Synthetic peptide
TNPFHHGKITHE

SEQ ID NO: 229 - protein, 21 aa, Artificial Sequence
  Description of Artificial Sequence: Synthetic peptide
AGTDSAHTDDGHTEPVMIRKD

SEQ ID NO: 230 - protein, 17 aa, Artificial Sequence
  Description of Artificial Sequence: Synthetic peptide
ITQLDKRQQLSLVKALE

SEQ ID NO: 231 - protein, 17 aa, Artificial Sequence
  Description of Artificial Sequence: Synthetic peptide
TGRDIPNPFIGSKIEFE

SEQ ID NO: 232 - protein, 11 aa, Artificial Sequence
  Description of Artificial Sequence: Synthetic peptide
TLDKMNLRHDE

SEQ ID NO: 233 - protein, 20 aa, Artificial Sequence
  Description of Artificial Sequence: Synthetic peptide
INHNQFTKKHAVPNDVFKYE

SEQ ID NO: 234 - protein, 12 aa, Artificial Sequence
  Description of Artificial Sequence: Synthetic peptide
IGGMNLHEIEKE

SEQ ID NO: 235 - protein, 15 aa, Artificial Sequence
  Description of Artificial Sequence: Synthetic peptide
AEELRDALYKLQNDE

SEQ ID NO: 236 - protein, 8 aa, Artificial Sequence
  Description of Artificial Sequence: Synthetic peptide
LGKMYSVE

SEQ ID NO: 237 - protein, 10 aa, Artificial Sequence
  Description of Artificial Sequence: Synthetic peptide
VLGGPSEMKW

SEQ ID NO: 238 - protein, 7 aa, Artificial Sequence
  Description of Artificial Sequence: Synthetic peptide
TVKAELF

SEQ ID NO: 239 - protein, 22 aa, Artificial Sequence
  Description of Artificial Sequence: Synthetic peptide
GGISLENIEKMIHENQQEDRIY

SEQ ID NO: 240 - protein, 14 aa, Artificial Sequence
  Description of Artificial Sequence: Synthetic peptide
IKTTDSVQHKAGTF

SEQ ID NO: 241 - protein, 12 aa, Artificial Sequence
  Description of Artificial Sequence: Synthetic peptide
ALLKEDKSAGGF

SEQ ID NO: 242 - protein, 8 aa, Artificial Sequence
  Description of Artificial Sequence: Synthetic peptide
TSIAKQVL

SEQ ID NO: 243 - protein, 6 aa, Artificial Sequence
  Description of Artificial Sequence: Synthetic peptide
QALQKY

SEQ ID NO: 244 - protein, 9 aa, Artificial Sequence
  Description of Artificial Sequence: Synthetic peptide
NVFDYKTNF

SEQ ID NO: 245 - protein, 6 aa, Artificial Sequence
  Description of Artificial Sequence: Synthetic peptide
ESIAKF

SEQ ID NO: 246 - protein, 16 aa, Artificial Sequence
  Description of Artificial Sequence: Synthetic peptide
TKRIEHLPHLISDATY

SEQ ID NO: 247 - protein, 8 aa, Artificial Sequence
  Description of Artificial Sequence: Synthetic peptide
KLDITKAL

SEQ ID NO: 248 - protein, 16 aa, Artificial Sequence
  Description of Artificial Sequence: Synthetic peptide
NLNDHTHDFSKPEDTF

SEQ ID NO: 249 - protein, 11 aa, Artificial Sequence
  Description of Artificial Sequence: Synthetic peptide
TVLGGEKEMPW

SEQ ID NO: 250 - protein, 10 aa, Artificial Sequence
  Description of Artificial Sequence: Synthetic peptide
SERDIGSLKY

SEQ ID NO: 251 - protein, 25 aa, Artificial Sequence
  Description of Artificial Sequence: Synthetic peptide
KYDITHALHDAHITPEDVFHPSEPF

SEQ ID NO: 252 - protein, 13 aa, Artificial Sequence
  Description of Artificial Sequence: Synthetic peptide
THSNAKPTDVFEY

SEQ ID NO: 253 - protein, 11 aa, Artificial Sequence
  Description of Artificial Sequence: Synthetic peptide
KLQNDESHGGY

SEQ ID NO: 254 - protein, 12 aa, Artificial Sequence
  Description of Artificial Sequence: Synthetic peptide
ADSGNNNPFFKY

SEQ ID NO: 255 - protein, 30 aa, Artificial Sequence
  Description of Artificial Sequence: Synthetic polypeptide
HIRSINQDTVRDVNEAIFQQTKFGEFSSIF

SEQ ID NO: 256 - protein, 17 aa, Artificial Sequence
  Description of Artificial Sequence: Synthetic peptide
EILHNEVHALIGGAEKY

SEQ ID NO: 257 - protein, 15 aa, Artificial Sequence
  Description of Artificial Sequence: Synthetic peptide
IKSGTDSDDEYAGSF

SEQ ID NO: 258 - protein, 11 aa, Artificial Sequence
  Description of Artificial Sequence: Synthetic peptide
VILGGAKEMPW

SEQ ID NO: 259 - protein, 8 aa, Artificial Sequence
  Description of Artificial Sequence: Synthetic peptide
MTPEELKT

SEQ ID NO: 260 - protein, 19 aa, Artificial Sequence
  Description of Artificial Sequence: Synthetic peptide
VCIPDDNDRNDDHCEKAGD

SEQ ID NO: 261 - protein, 11 aa, Artificial Sequence
  Description of Artificial Sequence: Synthetic peptide
VLGGPSEMKWQ

SEQ ID NO: 262 - protein, 7 aa, Artificial Sequence
  Description of Artificial Sequence: Synthetic peptide
LSDTVHK

SEQ ID NO: 263 - protein, 8 aa, Artificial Sequence
  Description of Artificial Sequence: Synthetic peptide
VVHHPEKG

SEQ ID NO: 264 - protein, 8 aa, Artificial Sequence
  Description of Artificial Sequence: Synthetic peptide
ISLENIEK

SEQ ID NO: 265 - protein, 10 aa, Artificial Sequence
  Description of Artificial Sequence: Synthetic peptide
VDITEVDGTK

SEQ ID NO: 266 - protein, 7 aa, Artificial Sequence
  Description of Artificial Sequence: Synthetic peptide
LLKEDKS

SEQ ID NO: 267 - protein, 12 aa, Artificial Sequence
  Description of Artificial Sequence: Synthetic peptide
FHGEPKWCPSPE

SEQ ID NO: 268 - protein, 7 aa, Artificial Sequence
  Description of Artificial Sequence: Synthetic peptide
LADHEKY

SEQ ID NO: 269 - protein, 13 aa, Artificial Sequence
  Description of Artificial Sequence: Synthetic peptide
VDPEDGVEKHNPW

SEQ ID NO: 270 - protein, 8 aa, Artificial Sequence
  Description of Artificial Sequence: Synthetic peptide
VTKEHSVP

SEQ ID NO: 271 - protein, 7 aa, Artificial Sequence
  Description of Artificial Sequence: Synthetic peptide
VFDYKTN

SEQ ID NO: 272 - protein, 6 aa, Artificial Sequence
  Description of Artificial Sequence: Synthetic peptide
LFKQPS

SEQ ID NO: 273 - protein, 5 aa, Artificial Sequence
  Description of Artificial Sequence: Synthetic peptide
FHHGK

SEQ ID NO: 274 - protein, 14 aa, Artificial Sequence
  Description of Artificial Sequence: Synthetic peptide
FDKSDNNDEATKTH

SEQ ID NO: 275 - protein, 8 aa, Artificial Sequence
  Description of Artificial Sequence: Synthetic peptide
VGGKEPYG

SEQ ID NO: 276 - protein, 12 aa, Artificial Sequence
  Description of Artificial Sequence: Synthetic peptide
FSKPEDTFDYQK

SEQ ID NO: 277 - protein, 12 aa, Artificial Sequence
  Description of Artificial Sequence: Synthetic peptide
FSKPEDTFDYQK

SEQ ID NO: 278 - protein, 9 aa, Artificial Sequence
  Description of Artificial Sequence: Synthetic peptide
VLGGEKEMP

SEQ ID NO: 279 - protein, 11 aa, Artificial Sequence
  Description of Artificial Sequence: Synthetic peptide
VAVPYWDWTKP

SEQ ID NO: 280 - protein, 5 aa, Artificial Sequence
  Description of Artificial Sequence: Synthetic peptide
FTKKH

SEQ ID NO: 281 - protein, 7 aa, Artificial Sequence
  Description of Artificial Sequence: Synthetic peptide
LHEIEKE

SEQ ID NO: 282 - protein, 13 aa, Artificial Sequence
  Description of Artificial Sequence: Synthetic peptide
ICKTSEDCHHGGQ

SEQ ID NO: 283 - protein, 11 aa, Artificial Sequence
  Description of Artificial Sequence: Synthetic peptide
LTTAEVDNLKD

SEQ ID NO: 284 - protein, 8 aa, Artificial Sequence
  Description of Artificial Sequence: Synthetic peptide
AKPTDVFE

SEQ ID NO: 285 - protein, 10 aa, Artificial Sequence
  Description of Artificial Sequence: Synthetic peptide
LEKQKEEDRT

SEQ ID NO: 286 - protein, 12 aa, Artificial Sequence
  Description of Artificial Sequence: Synthetic peptide
IIDTSGKQLPSD

SEQ ID NO: 287 - protein, 6 aa, Artificial Sequence
  Description of Artificial Sequence: Synthetic peptide
LIKMPT

SEQ ID NO: 288 - protein, 6 aa, Artificial Sequence
  Description of Artificial Sequence: Synthetic peptide
IFQQTK

SEQ ID NO: 289 - protein, 9 aa, Artificial Sequence
  Description of Artificial Sequence: Synthetic peptide
LIGGAEKYS

SEQ ID NO: 290 - protein, 15 aa, Artificial Sequence
  Description of Artificial Sequence: Synthetic peptide
IKSGTDSDDEYAGSF

SEQ ID NO: 291 - protein, 7 aa, Artificial Sequence
  Description of Artificial Sequence: Synthetic peptide
LTDDHVK

SEQ ID NO: 292 - protein, 16 aa, Artificial Sequence
  Description of Artificial Sequence: Synthetic peptide
KNVDSLSSDEVLALEK

SEQ ID NO: 293 - protein, 9 aa, Artificial Sequence
  Description of Artificial Sequence: Synthetic peptide
ADITFLNKK

SEQ ID NO: 294 - protein, 12 aa, Artificial Sequence
  Description of Artificial Sequence: Synthetic peptide
LFEKVQPGHHTR

SEQ ID NO: 295 - protein, 23 aa, Artificial Sequence
  Description of Artificial Sequence: Synthetic peptide
GKDPNSADCAHNLIHTPMEPFDR

SEQ ID NO: 296 - protein, 13 aa, Artificial Sequence
  Description of Artificial Sequence: Synthetic peptide
EHAKPADSFDYGR

SEQ ID NO: 297 - protein, 28 aa, Artificial Sequence
  Description of Artificial Sequence: Synthetic peptide
QPTLVHRPAKGHFDKPPVPVAQANLAVR

SEQ ID NO: 298 - protein, 18 aa, Artificial Sequence
  Description of Artificial Sequence: Synthetic peptide
GHFDKPPVPVAQANLAVR

SEQ ID NO: 299 - protein, 22 aa, Artificial Sequence
  Description of Artificial Sequence: Synthetic peptide
FQNDKSVDGYQATVEFHALPAR

SEQ ID NO: 300 - protein, 8 aa, Artificial Sequence
  Description of Artificial Sequence: Synthetic peptide
EMKWGFDR

SEQ ID NO: 301 - protein, 15 aa, Artificial Sequence
  Description of Artificial Sequence: Synthetic peptide
KHGFTGGLPYWDWTR

SEQ ID NO: 302 - protein, 58 aa, Artificial Sequence
  Description of Artificial Sequence: Synthetic polypeptide
DDLYQSPGFGHYTDIAKQVLLAFEQDDFCDFEVQFEIAHNFIHALVGGNEPYSMSSLR

SEQ ID NO: 303 - protein, 15 aa, Artificial Sequence
  Description of Artificial Sequence: Synthetic peptide
GKPYNTANCAIASMR

SEQ ID NO: 304 - protein, 19 aa, Artificial Sequence
  Description of Artificial Sequence: Synthetic peptide
KPLQPFGLDSVINPDDETR

SEQ ID NO: 305 - protein, 27 aa, Artificial Sequence
  Description of Artificial Sequence: Synthetic peptide
VFDYKNNFDYEYESLAFNGLSIAQLDR

SEQ ID NO: 306 - protein, 17 aa, Artificial Sequence
  Description of Artificial Sequence: Synthetic peptide
SAFLQIQKEGIYENIAK

SEQ ID NO: 307 - protein, 31 aa, Artificial Sequence; identical to SEQ ID NO: 25
  Description of Artificial Sequence: Synthetic polypeptide

SEQ ID NO: 308 - protein, 42 aa, Artificial Sequence
  Description of Artificial Sequence: Synthetic polypeptide
DPQPELWDNKDFYENVMLALEQDNFCDFEIQLELIHNALHSR

SEQ ID NO: 309 - protein, 26 aa, Artificial Sequence
  Description of Artificial Sequence: Synthetic peptide
AKYSLSSLDYTAFDPVFFLHHANVDR

SEQ ID NO: 310 - protein, 15 aa, Artificial Sequence
  Description of Artificial Sequence: Synthetic peptide
KKPYNEADCAVNEMR

SEQ ID NO: 311 - protein, 15 aa, Artificial Sequence
  Description of Artificial Sequence: Synthetic peptide
KKPYNEADCAVNEMR

SEQ ID NO: 312 - protein, 19 aa, Artificial Sequence
  Description of Artificial Sequence: Synthetic peptide
KPLQPFNNPELNSDSMTLK

SEQ ID NO: 313 - protein, 32 aa, Artificial Sequence; identical to SEQ ID NO: 27
  Description of Artificial Sequence: Synthetic polypeptide

SEQ ID NO: 314 - protein, 23 aa, Artificial Sequence
  Description of Artificial Sequence: Synthetic peptide
YQYDNLQFNHFSIQKLDQTIQAR

SEQ ID NO: 315 - protein, 12 aa, Artificial Sequence
  Description of Artificial Sequence: Synthetic peptide
LYKFDITSALHK

SEQ ID NO: 316 - protein, 11 aa, Artificial Sequence
  Description of Artificial Sequence: Synthetic peptide
KEVSSLTTLEK

SEQ ID NO: 317 - protein, 15 aa, Artificial Sequence
  Description of Artificial Sequence: Synthetic peptide
KEVSSLTTLEKHFLR

SEQ ID NO: 318 - protein, 12 aa, Artificial Sequence
  Description of Artificial Sequence: Synthetic peptide
LYTVQFEDSLKR

SEQ ID NO: 319 - protein, 35 aa, Artificial Sequence
  Description of Artificial Sequence: Synthetic polypeptide
HGSIVGLPYWDWLKPQSALPDLVTQETYEHLFSHK

SEQ ID NO: 320 - protein, 22 aa, Artificial Sequence
  Description of Artificial Sequence: Synthetic peptide
TFPNPFLKANIEFEGEGVTTER

SEQ ID NO: 321 - protein, 15 aa, Artificial Sequence
  Description of Artificial Sequence: Synthetic peptide
TQEFSKPEDTFDYHR

SEQ ID NO: 322 - protein, 8 aa, Artificial Sequence
  Description of Artificial Sequence: Synthetic peptide
YDITKTLK

SEQ ID NO: 323 - protein, 10 aa, Artificial Sequence
  Description of Artificial Sequence: Synthetic peptide
DLASLKSAMR

SEQ ID NO: 324 - protein, 12 aa, Artificial Sequence
  Description of Artificial Sequence: Synthetic peptide
GYIKSEDAYTVR

SEQ ID NO: 325 - protein, 11 aa, Artificial Sequence
  Description of Artificial Sequence: Synthetic peptide
NFKYDITQALK

SEQ ID NO: 326 - protein, 15 aa, Artificial Sequence
  Description of Artificial Sequence: Synthetic peptide
KDVTSLTASEIENLR

SEQ ID NO: 327 - protein, 12 aa, Artificial Sequence
  Description of Artificial Sequence: Synthetic peptide
IWAIWQALQKYR

SEQ ID NO: 328 - protein, 10 aa, Artificial Sequence
  Description of Artificial Sequence: Synthetic peptide
QPLKPFSESR

SEQ ID NO: 329 - protein, 8 aa, Artificial Sequence
  Description of Artificial Sequence: Synthetic peptide
KKPYNAAK

SEQ ID NO: 330 - protein, 12 aa, Artificial Sequence
  Description of Artificial Sequence: Synthetic peptide
KVQPGHHTRLME

SEQ ID NO: 331 - protein, 5 aa, Artificial Sequence
  Description of Artificial Sequence: Synthetic peptide
RAAKE

SEQ ID NO: 332 - protein, 24 aa, Artificial Sequence
  Description of Artificial Sequence: Synthetic peptide
KPPVPVAQANLAVRKNINDLTAEE

SEQ ID NO: 333 - protein, 16 aa, Artificial Sequence
  Description of Artificial Sequence: Synthetic peptide
RFQNDKSVDGYQATVE

SEQ ID NO: 334 - protein, 21 aa, Artificial Sequence
  Description of Artificial Sequence: Synthetic peptide
ITQQLHDLDLHVGDNFFLKYE

SEQ ID NO: 335 - protein, 12 aa, Artificial Sequence
  Description of Artificial Sequence: Synthetic peptide
SIRSAFLQIQKE

SEQ ID NO: 336 - protein, 13 aa, Artificial Sequence
  Description of Artificial Sequence: Synthetic peptide
NIAKFHGKPGLCE

SEQ ID NO: 337 - protein, 13 aa, Artificial Sequence
  Description of Artificial Sequence: Synthetic peptide
NIAKFHGKPGLCE

SEQ ID NO: 338 - protein, 20 aa, Artificial Sequence
  Description of Artificial Sequence: Synthetic peptide
NAVTSRDPQPELWDNKDFYE

SEQ ID NO: 339 - protein, 16 aa, Artificial Sequence
  Description of Artificial Sequence: Synthetic peptide
FSKPEDTFDYHRFGYE

SEQ ID NO: 340 - protein, 18 aa, Artificial Sequence
  Description of Artificial Sequence: Synthetic peptide
FVGMSVSSLHNYIKQQQE

SEQ ID NO: 341 - protein, 8 aa, Artificial Sequence
  Description of Artificial Sequence: Synthetic peptide
APFFIKVE

SEQ ID NO: 342 - protein, 20 aa, Artificial Sequence
  Description of Artificial Sequence: Synthetic peptide
LDHAYSLRDGHYYIAGPTKD

SEQ ID NO: 343 - protein, 18 aa, Artificial Sequence
  Description of Artificial Sequence: Synthetic peptide
ALEKALDDLQQDDSNQGY

SEQ ID NO: 344 - protein, 14 aa, Artificial Sequence
  Description of Artificial Sequence: Synthetic peptide
LNKKTSRAVDDRLF

SEQ ID NO: 345 - protein, 11 aa, Artificial Sequence
  Description of Artificial Sequence: Synthetic peptide
EKVQPGHHTRL

SEQ ID NO: 346 - protein, 20 aa, Artificial Sequence
  Description of Artificial Sequence: Synthetic peptide
DLTREHAKPADSFDYGRLGY

SEQ ID NO: 347 - protein, 10 aa, Artificial Sequence
  Description of Artificial Sequence: Synthetic peptide
LLGGPTEMKW

SEQ ID NO: 348 - protein, 7 aa, Artificial Sequence
  Description of Artificial Sequence: Synthetic peptide
VGGSEKY

SEQ ID NO: 349 - protein, 9 aa, Artificial Sequence
  Description of Artificial Sequence: Synthetic peptide
TDIAKQVLL

SEQ ID NO: 350 - protein, 6 aa, Artificial Sequence
  Description of Artificial Sequence: Synthetic peptide
QALQKY

SEQ ID NO: 351 - protein, 15 aa, Artificial Sequence
  Description of Artificial Sequence: Synthetic peptide
DYKNNFDYEYESLAF

SEQ ID NO: 352 - protein, 15 aa, Artificial Sequence
  Description of Artificial Sequence: Synthetic peptide
LQIQKEGIYENIAKF

SEQ ID NO: 353 - protein, 15 aa, Artificial Sequence
  Description of Artificial Sequence: Synthetic peptide
LQIQKEGIYENIAKF

SEQ ID NO: 354 - protein, 9 aa, Artificial Sequence
  Description of Artificial Sequence: Synthetic peptide
KHNLPQDSF

SEQ ID NO: 355 - protein, 18 aa, Artificial Sequence
  Description of Artificial Sequence: Synthetic peptide
ICVEQGGEQNCKTKAGSF

SEQ ID NO: 356 - protein, 18 aa, Artificial Sequence
  Description of Artificial Sequence: Synthetic peptide
ICVEQGGEQNCKTKAGSF

SEQ ID NO: 357 - protein, 7 aa, Artificial Sequence
  Description of Artificial Sequence: Synthetic peptide
TTLEKHF

SEQ ID NO: 358 - protein, 12 aa, Artificial Sequence
  Description of Artificial Sequence: Synthetic peptide
KNMQADDSPDGY

SEQ ID NO: 359 - protein, 15 aa, Artificial Sequence
  Description of Artificial Sequence: Synthetic peptide
KPQSALPDLVTQETY

SEQ ID NO: 360 - protein, 9 aa, Artificial Sequence
  Description of Artificial Sequence: Synthetic peptide
SHKTFPNPF

SEQ ID NO: 361 - protein, 12 aa, Artificial Sequence
  Description of Artificial Sequence: Synthetic peptide
SKPEDTFDYHRF

SEQ ID NO: 362 - protein, 11 aa, Artificial Sequence
  Description of Artificial Sequence: Synthetic peptide
IKQQQEADRVF

SEQ ID NO: 363 - protein, 11 aa, Artificial Sequence
  Description of Artificial Sequence: Synthetic peptide
KGFGQSASVSF

SEQ ID NO: 364 - protein, 8 aa, Artificial Sequence
  Description of Artificial Sequence: Synthetic peptide
KYDITQAL

SEQ ID NO: 365 - protein, 17 aa, Artificial Sequence
  Description of Artificial Sequence: Synthetic peptide
KAQSIHPEDVFDTDAPF

SEQ ID NO: 366 - protein, 27 aa, Artificial Sequence
  Description of Artificial Sequence: Synthetic peptide
SAGEGHTDDHGSDHIAGSGVRKDVTSL

SEQ ID NO: 367 - protein, 7 aa, Artificial Sequence
  Description of Artificial Sequence: Synthetic peptide
KQPLKPF

SEQ ID NO: 368 - protein, 7 aa, Artificial Sequence
  Description of Artificial Sequence: Synthetic peptide
KQPLKPF

SEQ ID NO: 369 - protein, 8 aa, Artificial Sequence
  Description of Artificial Sequence: Synthetic peptide
RYDITKVL

SEQ ID NO: 370 - protein, 8 aa, Artificial Sequence
  Description of Artificial Sequence: Synthetic peptide
TSANVKIY

SEQ ID NO: 371 - protein, 9 aa, Artificial Sequence
  Description of Artificial Sequence: Synthetic peptide
YIAGPTKDL

SEQ ID NO: 372 - protein, 7 aa, Artificial Sequence
  Description of Artificial Sequence: Synthetic peptide
VDKHEKN

SEQ ID NO: 373 - protein, 8 aa, Artificial Sequence
  Description of Artificial Sequence: Synthetic peptide
LEQDEFCK

SEQ ID NO: 374 - protein, 14 aa, Artificial Sequence
  Description of Artificial Sequence: Synthetic peptide
LRGKDPNSADCAHN

SEQ ID NO: 375 - protein, 11 aa, Artificial Sequence
  Description of Artificial Sequence: Synthetic peptide
AKPADSFDYGR

SEQ ID NO: 376 - protein, 11 aa, Artificial Sequence
  Description of Artificial Sequence: Synthetic peptide
LLGGPTEMKWG

SEQ ID NO: 377 - protein, 8 aa, Artificial Sequence
  Description of Artificial Sequence: Synthetic peptide
VGGSEKYS

SEQ ID NO: 378 - protein, 12 aa, Artificial Sequence
  Description of Artificial Sequence: Synthetic peptide
FHGEPKWCPSPE

SEQ ID NO: 379 - protein, 13 aa, Artificial Sequence
  Description of Artificial Sequence: Synthetic peptide
YWDWTEKADSLPS

SEQ ID NO: 380 - protein, 15 aa, Artificial Sequence
  Description of Artificial Sequence: Synthetic peptide
LKHNLPQDSFDYQNR

SEQ ID NO: 381 - protein, 17 aa, Artificial Sequence
  Description of Artificial Sequence: Synthetic peptide
ICVEQGGEQNCKTKAGS

SEQ ID NO: 382 - protein, 17 aa, Artificial Sequence
  Description of Artificial Sequence: Synthetic peptide
ICVEQGGEQNCKTKAGS

SEQ ID NO: 383 - protein, 6 aa, Artificial Sequence
  Description of Artificial Sequence: Synthetic peptide
FDIKVD

SEQ ID NO: 384 - protein, 10 aa, Artificial Sequence
  Description of Artificial Sequence: Synthetic peptide
FSHKTFPNPF

SEQ ID NO: 385 - protein, 12 aa, Artificial Sequence
  Description of Artificial Sequence: Synthetic peptide
FSKPEDTFDYHR

SEQ ID NO: 386 - protein, 9 aa, Artificial Sequence
  Description of Artificial Sequence: Synthetic peptide
IKQQQEADR

SEQ ID NO: 387 - protein, 7 aa, Artificial Sequence
  Description of Artificial Sequence: Synthetic peptide
YWDWTKP

SEQ ID NO: 388 - protein, 7 aa, Artificial Sequence
  Description of Artificial Sequence: Synthetic peptide
ISKLPDL

SEQ ID NO: 389 - protein, 5 aa, Artificial Sequence
  Description of Artificial Sequence: Synthetic peptide
FAKGY

SEQ ID NO: 390 - protein, 5 aa, Artificial Sequence
  Description of Artificial Sequence: Synthetic peptide
FTKMH

SEQ ID NO: 391 - protein, 10 aa, Artificial Sequence
  Description of Artificial Sequence: Synthetic peptide
LDEANDLKNA

SEQ ID NO: 392 - protein, 7 aa, Artificial Sequence
  Description of Artificial Sequence: Synthetic peptide
LKEHGSH

SEQ ID NO: 393 - protein, 7 aa, Artificial Sequence
  Description of Artificial Sequence: Synthetic peptide
IAGPTKD

SEQ ID NO: 394 - protein, 18 aa, Artificial Sequence
  Description of Artificial Sequence: Synthetic peptide
GFTDPPVKHHQSANLLVR

SEQ ID NO: 395 - protein, 8 aa, Artificial Sequence
  Description of Artificial Sequence: Synthetic peptide
KNINDLTR

SEQ ID NO: 396 - protein, 10 aa, Artificial Sequence
  Description of Artificial Sequence: Synthetic peptide
EAFHKFQEDR

SEQ ID NO: 397 - protein, 9 aa, Artificial Sequence
  Description of Artificial Sequence: Synthetic peptide
CPRPDAKDR

SEQ ID NO: 398 - protein, 8 aa, Artificial Sequence
  Description of Artificial Sequence: Synthetic peptide
VKFDKVPR

SEQ ID NO: 399 - protein, 5 aa, Artificial Sequence
  Description of Artificial Sequence: Synthetic peptide
KNVDR

SEQ ID NO: 400 - protein, 10 aa, Artificial Sequence
  Description of Artificial Sequence: Synthetic peptide
KALALLKEDK

SEQ ID NO: 401 - protein, 19 aa, Artificial Sequence
  Description of Artificial Sequence: Synthetic peptide
EDKSAGGFQQLGAFHGEPK

SEQ ID NO: 402 - protein, 37 aa, Artificial Sequence; identical to SEQ ID NO: 176
  Description of Artificial Sequence: Synthetic polypeptide

SEQ ID NO: 403 - protein, 18 aa, Artificial Sequence
  Description of Artificial Sequence: Synthetic peptide
HNPWFDGHIDTVDKTTTR

SEQ ID NO: 404 - protein, 20 aa, Artificial Sequence
  Description of Artificial Sequence: Synthetic peptide
SVQNKLFEQPEFGHYTSIAK

SEQ ID NO: 405 - protein, 12 aa, Artificial Sequence
  Description of Artificial Sequence: Synthetic peptide
IWAIWQALQKYR

SEQ ID NO: 406 - protein, 15 aa, Artificial Sequence
  Description of Artificial Sequence: Synthetic peptide
GKPYNVANCAVTSMR

SEQ ID NO: 407 - protein, 6 aa, Artificial Sequence
  Description of Artificial Sequence: Synthetic peptide
KLEAIK

SEQ ID NO: 408 - protein, 13 aa, Artificial Sequence
  Description of Artificial Sequence: Synthetic peptide
DLFKQPSVIHEPR

SEQ ID NO: 409 - protein, 15 aa, Artificial Sequence
  Description of Artificial Sequence: Synthetic peptide
KNIENLSLGELESLR

SEQ ID NO: 410 - protein, 13 aa, Artificial Sequence
  Description of Artificial Sequence: Synthetic peptide
LYVVVVENALLKK

SEQ ID NO: 411 - protein, 23 aa, Artificial Sequence
  Description of Artificial Sequence: Synthetic peptide
QHHYETNPFHHGKITHENEITTR

SEQ ID NO: 412 - protein, 5 aa, Artificial Sequence
  Description of Artificial Sequence: Synthetic peptide
KRPYR

SEQ ID NO: 413 - protein, 8 aa, Artificial Sequence
  Description of Artificial Sequence: Synthetic peptide
LDITKALK

SEQ ID NO: 414 - protein, 8 aa, Artificial Sequence
  Description of Artificial Sequence: Synthetic peptide
KDITQLDK

SEQ ID NO: 415 - protein, 17 aa, Artificial Sequence
  Description of Artificial Sequence: Synthetic peptide
KHGAVVGLPYWDWTLPR

SEQ ID NO: 416 - protein, 26 aa, Artificial Sequence
  Description of Artificial Sequence: Synthetic peptide
TAGDCEDAGYFTVLGGEKEMPWAFDR

SEQ ID NO: 417 - protein, 12 aa, Artificial Sequence
  Description of Artificial Sequence: Synthetic peptide
LYKYDITETLDK

SEQ ID NO: 418 - protein, 10 aa, Artificial Sequence
  Description of Artificial Sequence: Synthetic peptide
NKVMPNPFAR

SEQ ID NO: 419 - protein, 10 aa, Artificial Sequence
  Description of Artificial Sequence: Synthetic peptide
EIKDKQHHVR

SEQ ID NO: 420 - protein, 29 aa, Artificial Sequence
  Description of Artificial Sequence: Synthetic peptide
TSADVQFQICKTSEDCHHGGQIFVLGGTK

SEQ ID NO: 421 - protein, 9 aa, Artificial Sequence
  Description of Artificial Sequence: Synthetic peptide
DKLFNDPER

SEQ ID NO: 422 - protein, 8 aa, Artificial Sequence
  Description of Artificial Sequence: Synthetic peptide
KLEHELEK

SEQ ID NO: 423 - protein, 6 aa, Artificial Sequence
  Description of Artificial Sequence: Synthetic peptide
QKEEDR

SEQ ID NO: 424 - protein, 15 aa, Artificial Sequence
  Description of Artificial Sequence: Synthetic peptide
IIDTSGKQLPSDLIK

SEQ ID NO: 425 - protein, 16 aa, Artificial Sequence
  Description of Artificial Sequence: Synthetic peptide
HHEKHHEDHHEDILVR

SEQ ID NO: 426 - protein, 15 aa, Artificial Sequence
  Description of Artificial Sequence: Synthetic peptide
KNIHSLSHHEAEELR

SEQ ID NO: 427 - protein, 54 aa, Artificial Sequence; identical to SEQ ID NO: 209
  Description of Artificial Sequence: Synthetic polypeptide

SEQ ID NO: 428 - protein, 33 aa, Artificial Sequence; identical to SEQ ID NO: 13
  Description of Artificial Sequence: Synthetic polypeptide

SEQ ID NO: 429 - protein, 23 aa, Artificial Sequence
  Description of Artificial Sequence: Synthetic peptide
FNYKYDNLNLHGHNIEELEEVLR

SEQ ID NO: 430 - protein, 23 aa, Artificial Sequence
  Description of Artificial Sequence: Synthetic peptide
FDLKKYDHTELDASVLPAPIIVR

SEQ ID NO: 431 - protein, 19 aa, Artificial Sequence
  Description of Artificial Sequence: Synthetic peptide
KYDHTELDASVLPAPIIVR

SEQ ID NO: 432 - protein, 29 aa, Artificial Sequence
  Description of Artificial Sequence: Synthetic peptide
KGFTDPPVKHHQSANLLVRKNINDLTREE

SEQ ID NO: 433 - protein, 29 aa, Artificial Sequence
  Description of Artificial Sequence: Synthetic peptide
KGFTDPPVKHHQSANLLVRKNINDLTREE

SEQ ID NO: 434 - protein, 19 aa, Artificial Sequence
  Description of Artificial Sequence: Synthetic peptide
AFHKFQEDRSVDGYQATAE

SEQ ID NO: 435 - protein, 8 aa, Artificial Sequence
  Description of Artificial Sequence: Synthetic peptide
NIEKMIHE

SEQ ID NO: 436 - protein, 19 aa, Artificial Sequence
  Description of Artificial Sequence: Synthetic peptide
VDGTKLASSLIPHASVIRE

SEQ ID NO: 437 - protein, 24 aa, Artificial Sequence
  Description of Artificial Sequence: Synthetic peptide
DKSAGGFQQLGAFHGEPKWCPSPE

SEQ ID NO: 438 - protein, 24 aa, Artificial Sequence
  Description of Artificial Sequence: Synthetic peptide
DKSAGGFQQLGAFHGEPKWCPSPE

SEQ ID NO: 439 - protein, 11 aa, Artificial Sequence
  Description of Artificial Sequence: Synthetic peptide
LADHEKYVDPE

SEQ ID NO: 440 - protein, 17 aa, Artificial Sequence
  Description of Artificial Sequence: Synthetic peptide
HSVPFNVFDYKTNFNYE

SEQ ID NO: 441 - protein, 14 aa, Artificial Sequence
  Description of Artificial Sequence: Synthetic peptide
FNGLSISQLNKKLE

SEQ ID NO: 442 - protein, 29 aa, Artificial Sequence
  Description of Artificial Sequence: Synthetic peptide
VFDLKPASLGKDLFKQPSVIHEPRIGHHE

SEQ ID NO: 443 - protein, 22 aa, Artificial Sequence
  Description of Artificial Sequence: Synthetic peptide
NALLKKGSSVAVPYWDWTKRIE

SEQ ID NO: 444 - protein, 22 aa, Artificial Sequence
  Description of Artificial Sequence: Synthetic peptide
NALLKKGSSVAVPYWDWTKRIE

SEQ ID NO: 445 - protein, 14 aa, Artificial Sequence
  Description of Artificial Sequence: Synthetic peptide
TNPFHHGKITHENE

SEQ ID NO: 446 - protein, 21 aa, Artificial Sequence
  Description of Artificial Sequence: Synthetic peptide
AGTDSAHTDDGHTEPVMIRKD

SEQ ID NO: 447 - protein, 38 aa, Artificial Sequence
  Description of Artificial Sequence: Synthetic polypeptide
AGTDSAHTDDGHTEPVMIRKDITQLDKRQQLSLVKALE

SEQ ID NO: 448 - protein, 17 aa, Artificial Sequence
  Description of Artificial Sequence: Synthetic peptide
ITQLDKRQQLSLVKALE

SEQ ID NO: 449 - protein, 17 aa, Artificial Sequence
  Description of Artificial Sequence: Synthetic peptide
TGRDIPNPFIGSKIEFE

SEQ ID NO: 450 - protein, 11 aa, Artificial Sequence
  Description of Artificial Sequence: Synthetic peptide
TLDKMNLRHDE

SEQ ID NO: 451 - protein, 12 aa, Artificial Sequence
  Description of Artificial Sequence: Synthetic peptide
IGGMNLHEIEKE

SEQ ID NO: 452 - protein, 15 aa, Artificial Sequence
  Description of Artificial Sequence: Synthetic peptide
AEELRDALYKLQNDE

SEQ ID NO: 453 - protein, 8 aa, Artificial Sequence
  Description of Artificial Sequence: Synthetic peptide
LGKMYSVE

SEQ ID NO: 454 - protein, 10 aa, Artificial Sequence
  Description of Artificial Sequence: Synthetic peptide
VLGGPSEMKW

SEQ ID NO: 455 - protein, 12 aa, Artificial Sequence
  Description of Artificial Sequence: Synthetic peptide
HKFQEDRSVDGY

SEQ ID NO: 456 - protein, 12 aa, Artificial Sequence
  Description of Artificial Sequence: Synthetic peptide
ALLKEDKSAGGF

SEQ ID NO: 457 - protein, 9 aa, Artificial Sequence
  Description of Artificial Sequence: Synthetic peptide
TSIAKQVLL

SEQ ID NO: 458 - protein, 6 aa, Artificial Sequence
  Description of Artificial Sequence: Synthetic peptide
QALQKY

SEQ ID NO: 459 - protein, 10 aa, Artificial Sequence
  Description of Artificial Sequence: Synthetic peptide
EAIKSQDRFF

SEQ ID NO: 460 - protein, 12 aa, Artificial Sequence
  Description of Artificial Sequence: Synthetic peptide
DLKPASLGKDLF

SEQ ID NO: 461 - protein, 6 aa, Artificial Sequence
  Description of Artificial Sequence: Synthetic peptide
ESIAKF

SEQ ID NO: 462 - protein, 8 aa, Artificial Sequence
  Description of Artificial Sequence: Synthetic peptide
KLDITKAL

SEQ ID NO: 463 - protein, 7 aa, Artificial Sequence
  Description of Artificial Sequence: Synthetic peptide
IGSKIEF

SEQ ID NO: 464 - protein, 16 aa, Artificial Sequence
  Description of Artificial Sequence: Synthetic peptide
NLNDHTHDFSKPEDTF

SEQ ID NO: 465 - protein, 10 aa, Artificial Sequence
  Description of Artificial Sequence: Synthetic peptide
SERDIGSLKY

SEQ ID NO: 466 - protein, 7 aa, Artificial Sequence
  Description of Artificial Sequence: Synthetic peptide
KYELLGY

SEQ ID NO: 467 - protein, 25 aa, Artificial Sequence
  Description of Artificial Sequence: Synthetic peptide
KYDITHALHDAHITPEDVFHPSEPF

SEQ ID NO: 468 - protein, 13 aa, Artificial Sequence
  Description of Artificial Sequence: Synthetic peptide
THSNAKPTDVFEY

SEQ ID NO: 469 - protein, 17 aa, Artificial Sequence
  Description of Artificial Sequence: Synthetic peptide
KLQNDESHGGYEHIAGF

SEQ ID NO: 470 - protein, 12 aa, Artificial Sequence
  Description of Artificial Sequence: Synthetic peptide
ADSGNNNPFFKY

SEQ ID NO: 471 - protein, 15 aa, Artificial Sequence
  Description of Artificial Sequence: Synthetic peptide
IKSGTDSDDEYAGSF

SEQ ID NO: 472 - protein, 8 aa, Artificial Sequence
  Description of Artificial Sequence: Synthetic peptide
GGAKEMPW

SEQ ID NO: 473 - protein, 9 aa, Artificial Sequence
  Description of Artificial Sequence: Synthetic peptide
MTPEELKTY

SEQ ID NO: 474 - protein, 19 aa, Artificial Sequence
  Description of Artificial Sequence: Synthetic peptide
VCIPDDNDRNDDHCEKAGD

SEQ ID NO: 475 - protein, 11 aa, Artificial Sequence
  Description of Artificial Sequence: Synthetic peptide
VLGGPSEMKWQ

SEQ ID NO: 476 - protein, 7 aa, Artificial Sequence
  Description of Artificial Sequence: Synthetic peptide
LSDTVHK

SEQ ID NO: 477 - protein, 8 aa, Artificial Sequence
  Description of Artificial Sequence: Synthetic peptide
VVHHPEKG

SEQ ID NO: 478 - protein, 9 aa, Artificial Sequence
  Description of Artificial Sequence: Synthetic peptide
ISLENIEKM

SEQ ID NO: 479 - protein, 10 aa, Artificial Sequence
  Description of Artificial Sequence: Synthetic peptide
VDITEVDGTK

SEQ ID NO: 480 - protein, 7 aa, Artificial Sequence
  Description of Artificial Sequence: Synthetic peptide
LLKEDKS

SEQ ID NO: 481 - protein, 12 aa, Artificial Sequence
  Description of Artificial Sequence: Synthetic peptide
FHGEPKWCPSPE

SEQ ID NO: 482 - protein, 7 aa, Artificial Sequence
  Description of Artificial Sequence: Synthetic peptide
LADHEKY

SEQ ID NO: 483 - protein, 8 aa, Artificial Sequence
  Description of Artificial Sequence: Synthetic peptide
VTKEHSVP

SEQ ID NO: 484 - protein, 7 aa, Artificial Sequence
  Description of Artificial Sequence: Synthetic peptide
VFDYKTN

SEQ ID NO: 485 - protein, 5 aa, Artificial Sequence
  Description of Artificial Sequence: Synthetic peptide
FHHGK

SEQ ID NO: 486 - protein, 10 aa, Artificial Sequence
  Description of Artificial Sequence: Synthetic peptide
ITTRDPKDSL

SEQ ID NO: 487 - protein, 9 aa, Artificial Sequence
  Description of Artificial Sequence: Synthetic peptide
LLGGKGKYS

SEQ ID NO: 488 - protein, 14 aa, Artificial Sequence
  Description of Artificial Sequence: Synthetic peptide
FDKSDNNDEATKTH

SEQ ID NO: 489 - protein, 14 aa, Artificial Sequence
  Description of Artificial Sequence: Synthetic peptide
FDKSDNNDEATKTH

SEQ ID NO: 490 - protein, 8 aa, Artificial Sequence
  Description of Artificial Sequence: Synthetic peptide
VGGKEPYG

SEQ ID NO: 491 - protein, 12 aa, Artificial Sequence
  Description of Artificial Sequence: Synthetic peptide
FSKPEDTFDYQK

SEQ ID NO: 492 - protein, 12 aa, Artificial Sequence
  Description of Artificial Sequence: Synthetic peptide
FSKPEDTFDYQK

SEQ ID NO: 493 - protein, 9 aa, Artificial Sequence
  Description of Artificial Sequence: Synthetic peptide
VLGGEKEMP

SEQ ID NO: 494 - protein, 5 aa, Artificial Sequence
  Description of Artificial Sequence: Synthetic peptide
LDKMN

SEQ ID NO: 495 - protein, 11 aa, Artificial Sequence
  Description of Artificial Sequence: Synthetic peptide
VAVPYWDWTKP

SEQ ID NO: 496 - protein, 5 aa, Artificial Sequence
  Description of Artificial Sequence: Synthetic peptide
FTKKH

SEQ ID NO: 497 - protein, 7 aa, Artificial Sequence
  Description of Artificial Sequence: Synthetic peptide
LHEIEKE

SEQ ID NO: 498 - protein, 13 aa, Artificial Sequence
  Description of Artificial Sequence: Synthetic peptide
ICKTSEDCHHGGQ

SEQ ID NO: 499 - protein, 11 aa, Artificial Sequence
  Description of Artificial Sequence: Synthetic peptide
LTTAEVDNLKD

SEQ ID NO: 500 - protein, 13 aa, Artificial Sequence
  Description of Artificial Sequence: Synthetic peptide
FTHSNAKPTDVFE

SEQ ID NO: 501 - protein, 10 aa, Artificial Sequence
  Description of Artificial Sequence: Synthetic peptide
LEKQKEEDRT

SEQ ID NO: 502 - protein, 14 aa, Artificial Sequence
  Description of Artificial Sequence: Synthetic peptide
LEHELEKQKEEDRT

SEQ ID NO: 503 - protein, 12 aa, Artificial Sequence
  Description of Artificial Sequence: Synthetic peptide
IIDTSGKQLPSD

SEQ ID NO: 504 - protein, 6 aa, Artificial Sequence
  Description of Artificial Sequence: Synthetic peptide
LIKMPT

SEQ ID NO: 505 - protein, 6 aa, Artificial Sequence
  Description of Artificial Sequence: Synthetic peptide
IFQQTK

SEQ ID NO: 506 - protein, 9 aa, Artificial Sequence
  Description of Artificial Sequence: Synthetic peptide
LIGGAEKYS

SEQ ID NO: 507 - protein, 15 aa, Artificial Sequence
  Description of Artificial Sequence: Synthetic peptide
IKSGTDSDDEYAGSF

SEQ ID NO: 508 - protein, 7 aa, Artificial Sequence
  Description of Artificial Sequence: Synthetic peptide
LTDDHVK

SEQ ID NO: 509 - protein, 9 aa, Artificial Sequence
  Description of Artificial Sequence: Synthetic peptide
FKCKVPPFS

SEQ ID NO: 510 - protein, 16 aa, Artificial Sequence
  Description of Artificial Sequence: Synthetic peptide
KNVDSLSSDEVLALEK

SEQ ID NO: 511 - protein, 9 aa, Artificial Sequence
  Description of Artificial Sequence: Synthetic peptide
ADITFLNKK

SEQ ID NO: 512 - protein, 12 aa, Artificial Sequence
  Description of Artificial Sequence: Synthetic peptide
LFEKVQPGHHTR

SEQ ID NO: 513 - protein, 23 aa, Artificial Sequence
  Description of Artificial Sequence: Synthetic peptide
GKDPNSADCAHNLIHTPMEPFDR

SEQ ID NO: 514 - protein, 13 aa, Artificial Sequence
  Description of Artificial Sequence: Synthetic peptide
EHAKPADSFDYGR

SEQ ID NO: 515 - protein, 28 aa, Artificial Sequence
  Description of Artificial Sequence: Synthetic peptide
QPTLVHRPAKGHFDKPPVPVAQANLAVR

SEQ ID NO: 516 - protein, 18 aa, Artificial Sequence
  Description of Artificial Sequence: Synthetic peptide
GHFDKPPVPVAQANLAVR

SEQ ID NO: 517 - protein, 22 aa, Artificial Sequence
  Description of Artificial Sequence: Synthetic peptide
FQNDKSVDGYQATVEFHALPAR

SEQ ID NO: 518 - protein, 9 aa, Artificial Sequence
  Description of Artificial Sequence: Synthetic peptide
CPRPDAKDR

SEQ ID NO: 519 - protein, 15 aa, Artificial Sequence
  Description of Artificial Sequence: Synthetic peptide
KHGFTGGLPYWDWTR

SEQ ID NO: 520 - protein, 15 aa, Artificial Sequence
  Description of Artificial Sequence: Synthetic peptide
GKPYNTANCAIASMR

SEQ ID NO: 521 - protein, 19 aa, Artificial Sequence
  Description of Artificial Sequence: Synthetic peptide
KPLQPFGLDSVINPDDETR

SEQ ID NO: 522 - protein, 27 aa, Artificial Sequence
  Description of Artificial Sequence: Synthetic peptide
VFDYKNNFDYEYESLAFNGLSIAQLDR

SEQ ID NO: 523 - protein, 31 aa, Artificial Sequence; identical to SEQ ID NO: 25
  Description of Artificial Sequence: Synthetic polypeptide

SEQ ID NO: 524 - protein, 42 aa, Artificial Sequence; identical to SEQ ID NO: 308
  Description of Artificial Sequence: Synthetic polypeptide

SEQ ID NO: 525 - protein, 26 aa, Artificial Sequence
  Description of Artificial Sequence: Synthetic peptide
AKYSLSSLDYTAFDPVFFLHHANVDR

SEQ ID NO: 526 - protein, 15 aa, Artificial Sequence
  Description of Artificial Sequence: Synthetic peptide
KKPYNEADCAVNEMR

SEQ ID NO: 527 - protein, 23 aa, Artificial Sequence
  Description of Artificial Sequence: Synthetic peptide
YQYDNLQFNHFSIQKLDQTIQAR

SEQ ID NO: 528 - protein, 14 aa, Artificial Sequence
  Description of Artificial Sequence: Synthetic peptide
EVSSLTTLEKHFLR

SEQ ID NO: 529 - protein, 12 aa, Artificial Sequence
  Description of Artificial Sequence: Synthetic peptide
LYTVQFEDSLKR

SEQ ID NO: 530 - protein, 22 aa, Artificial Sequence
  Description of Artificial Sequence: Synthetic peptide
TFPNPFLKANIEFEGEGVTTER

SEQ ID NO: 531 - protein, 15 aa, Artificial Sequence
  Description of Artificial Sequence: Synthetic peptide
TQEFSKPEDTFDYHR

SEQ ID NO: 532 - protein, 12 aa, Artificial Sequence
  Description of Artificial Sequence: Synthetic peptide
GYIKSEDAYTVR

SEQ ID NO: 533 - protein, 15 aa, Artificial Sequence
  Description of Artificial Sequence: Synthetic peptide
KDVTSLTASEIENLR

SEQ ID NO: 534 - protein, 12 aa, Artificial Sequence
  Description of Artificial Sequence: Synthetic peptide
IWAIWQALQKYR

SEQ ID NO: 535 - protein, 10 aa, Artificial Sequence
  Description of Artificial Sequence: Synthetic peptide
QPLKPFSESR

SEQ ID NO: 536 - protein, 8 aa, Artificial Sequence
  Description of Artificial Sequence: Synthetic peptide
YDITKVLK

SEQ ID NO: 537 - protein, 8 aa, Artificial Sequence
  Description of Artificial Sequence: Synthetic peptide
KKPYNAAK

SEQ ID NO: 538 - protein, 12 aa, Artificial Sequence
  Description of Artificial Sequence: Synthetic peptide
KVQPGHHTRLME

SEQ ID NO: 539 - protein, 24 aa, Artificial Sequence
  Description of Artificial Sequence: Synthetic peptide
KPPVPVAQANLAVRKNINDLTAEE

SEQ ID NO: 540 - protein, 16 aa, Artificial Sequence
  Description of Artificial Sequence: Synthetic peptide
RFQNDKSVDGYQATVE

SEQ ID NO: 541 - protein, 19 aa, Artificial Sequence
  Description of Artificial Sequence: Synthetic peptide
HSVPFRVFDYKNNFDYEYE

SEQ ID NO: 542 - protein, 21 aa, Artificial Sequence
  Description of Artificial Sequence: Synthetic peptide
ITQQLHDLDLHVGDNFFLKYE

SEQ ID NO: 543 - protein, 12 aa, Artificial Sequence
  Description of Artificial Sequence: Synthetic peptide
SIRSAFLQIQKE

SEQ ID NO: 544 - protein, 13 aa, Artificial Sequence
  Description of Artificial Sequence: Synthetic peptide
NIAKFHGKPGLCE

SEQ ID NO: 545 - protein, 13 aa, Artificial Sequence
  Description of Artificial Sequence: Synthetic peptide
NIAKFHGKPGLCE

SEQ ID NO: 546 - protein, 16 aa, Artificial Sequence
  Description of Artificial Sequence: Synthetic peptide
FSKPEDTFDYHRFGYE

SEQ ID NO: 547 - protein, 18 aa, Artificial Sequence
  Description of Artificial Sequence: Synthetic peptide
FVGMSVSSLHNYIKQQQE

SEQ ID NO: 548 - protein, 14 aa, Artificial Sequence
  Description of Artificial Sequence: Synthetic peptide
DVFDTDAPFFIKVE

SEQ ID NO: 549 - protein, 20 aa, Artificial Sequence
  Description of Artificial Sequence: Synthetic peptide
LDHAYSLRDGHYYIAGPTKD

SEQ ID NO: 550 - protein, 13 aa, Artificial Sequence
  Description of Artificial Sequence: Synthetic peptide
NKKTSRAVDDRLF

SEQ ID NO: 551 - protein, 20 aa, Artificial Sequence
  Description of Artificial Sequence: Synthetic peptide
DLTREHAKPADSFDYGRLGY

SEQ ID NO: 552 - protein, 10 aa, Artificial Sequence
  Description of Artificial Sequence: Synthetic peptide
LLGGPTEMKW

SEQ ID NO: 553 - protein, 12 aa, Artificial Sequence
  Description of Artificial Sequence: Synthetic peptide
DKPPVPVAQANL

SEQ ID NO: 554 - protein, 7 aa, Artificial Sequence
  Description of Artificial Sequence: Synthetic peptide
VGGSEKY

SEQ ID NO: 555 - protein, 6 aa, Artificial Sequence
  Description of Artificial Sequence: Synthetic peptide
QALQKY

SEQ ID NO: 556 - protein, 19 aa, Artificial Sequence
  Description of Artificial Sequence: Synthetic peptide
KYEITQQLHDLDLHVGDNF

SEQ ID NO: 557 - protein, 15 aa, Artificial Sequence
  Description of Artificial Sequence: Synthetic peptide
LQIQKEGIYENIAKF

SEQ ID NO: 558 - protein, 15 aa, Artificial Sequence
  Description of Artificial Sequence: Synthetic peptide
LQIQKEGIYENIAKF

SEQ ID NO: 559 - protein, 11 aa, Artificial Sequence
  Description of Artificial Sequence: Synthetic peptide
KHNLPQDSFDY

SEQ ID NO: 560 - protein, 18 aa, Artificial Sequence
  Description of Artificial Sequence: Synthetic peptide
ICVEQGGEQNCKTKAGSF

SEQ ID NO: 561 - protein, 7 aa, Artificial Sequence
  Description of Artificial Sequence: Synthetic peptide
TTLEKHF

SEQ ID NO: 562 - protein, 12 aa, Artificial Sequence
  Description of Artificial Sequence: Synthetic peptide
KNMQADDSPDGY

SEQ ID NO: 563 - protein, 9 aa, Artificial Sequence
  Description of Artificial Sequence: Synthetic peptide
SHKTFPNPF

SEQ ID NO: 564 - protein, 11 aa, Artificial Sequence
  Description of Artificial Sequence: Synthetic peptide
IKQQQEADRVF

SEQ ID NO: 565 - protein, 11 aa, Artificial Sequence
  Description of Artificial Sequence: Synthetic peptide
KGFGQSASVSF

SEQ ID NO: 566 - protein, 15 aa, Artificial Sequence
  Description of Artificial Sequence: Synthetic peptide
ICKTADDCHASGMIF

SEQ ID NO: 567 - protein, 8 aa, Artificial Sequence
  Description of Artificial Sequence: Synthetic peptide
KYDITQAL

SEQ ID NO: 568 - protein, 17 aa, Artificial Sequence
  Description of Artificial Sequence: Synthetic peptide
KAQSIHPEDVFDTDAPF

SEQ ID NO: 569 - protein, 27 aa, Artificial Sequence
  Description of Artificial Sequence: Synthetic peptide
SAGEGHTDDHGSDHIAGSGVRKDVTSL

SEQ ID NO: 570 - protein, 7 aa, Artificial Sequence
  Description of Artificial Sequence: Synthetic peptide
KQPLKPF

SEQ ID NO: 571 - protein, 7 aa, Artificial Sequence
  Description of Artificial Sequence: Synthetic peptide
KQPLKPF

SEQ ID NO: 572 - protein, 8 aa, Artificial Sequence
  Description of Artificial Sequence: Synthetic peptide
RYDITKVL

SEQ ID NO: 573 - protein, 8 aa, Artificial Sequence
  Description of Artificial Sequence: Synthetic peptide
TSANVKIY

SEQ ID NO: 574 - protein, 8 aa, Artificial Sequence
  Description of Artificial Sequence: Synthetic peptide
IAGPTKDL

SEQ ID NO: 575 - protein, 11 aa, Artificial Sequence
  Description of Artificial Sequence: Synthetic peptide
LDALEQDEFCK

SEQ ID NO: 576 - protein, 14 aa, Artificial Sequence
  Description of Artificial Sequence: Synthetic peptide
LRGKDPNSADCAHN

SEQ ID NO: 577 - protein, 11 aa, Artificial Sequence
  Description of Artificial Sequence: Synthetic peptide
AKPADSFDYGR

SEQ ID NO: 578 - protein, 10 aa, Artificial Sequence
  Description of Artificial Sequence: Synthetic peptide
LGGPTEMKWG

SEQ ID NO: 579 - protein, 7 aa, Artificial Sequence
  Description of Artificial Sequence: Synthetic peptide
FDKPPVP

SEQ ID NO: 580 - protein, 6 aa, Artificial Sequence
  Description of Artificial Sequence: Synthetic peptide
FQNDKS

SEQ ID NO: 581 - protein, 8 aa, Artificial Sequence
  Description of Artificial Sequence: Synthetic peptide
VGGSEKYS

SEQ ID NO: 582 - protein, 12 aa, Artificial Sequence
  Description of Artificial Sequence: Synthetic peptide
FHGEPKWCPSPE

SEQ ID NO: 583 - protein, 6 aa, Artificial Sequence
  Description of Artificial Sequence: Synthetic peptide
LWDNKD

SEQ ID NO: 584 - protein, 15 aa, Artificial Sequence
  Description of Artificial Sequence: Synthetic peptide
LKHNLPQDSFDYQNR

SEQ ID NO: 585 - protein, 17 aa, Artificial Sequence
  Description of Artificial Sequence: Synthetic peptide
ICVEQGGEQNCKTKAGS

SEQ ID NO: 586 - protein, 17 aa, Artificial Sequence
  Description of Artificial Sequence: Synthetic peptide
ICVEQGGEQNCKTKAGS

SEQ ID NO: 587 - protein, 10 aa, Artificial Sequence
  Description of Artificial Sequence: Synthetic peptide
FSHKTFPNPF

SEQ ID NO: 588 - protein, 12 aa, Artificial Sequence
  Description of Artificial Sequence: Synthetic peptide
FSKPEDTFDYHR

SEQ ID NO: 589 - protein, 10 aa, Artificial Sequence
  Description of Artificial Sequence: Synthetic peptide
IKQQQEADRV

SEQ ID NO: 590 - protein, 7 aa, Artificial Sequence
  Description of Artificial Sequence: Synthetic peptide
YWDWTKP

SEQ ID NO: 591 - protein, 7 aa, Artificial Sequence
  Description of Artificial Sequence: Synthetic peptide
ISKLPDL

SEQ ID NO: 592 - protein, 5 aa, Artificial Sequence
  Description of Artificial Sequence: Synthetic peptide
FAKGY

SEQ ID NO: 593 - protein, 5 aa, Artificial Sequence
  Description of Artificial Sequence: Synthetic peptide
FTKMH

SEQ ID NO: 594 - protein, 10 aa, Artificial Sequence
  Description of Artificial Sequence: Synthetic peptide
LDEANDLKNA

SEQ ID NO: 595 - protein, 7 aa, Artificial Sequence
  Description of Artificial Sequence: Synthetic peptide
LKEHGSH

SEQ ID NO: 596 - protein, 7 aa, Artificial Sequence
  Description of Artificial Sequence: Synthetic peptide
YWDWTKS

SEQ ID NO: 597 - protein, 7 aa, Artificial Sequence
  Description of Artificial Sequence: Synthetic peptide
IAGPTKD

SEQ ID NO: 598 - protein, 18 aa, Artificial Sequence
  Description of Artificial Sequence: Synthetic peptide
GFTDPPVKHHQSANLLVR

SEQ ID NO: 599 - protein, 8 aa, Artificial Sequence
  Description of Artificial Sequence: Synthetic peptide
KNINDLTR

SEQ ID NO: 600 - protein, 10 aa, Artificial Sequence
  Description of Artificial Sequence: Synthetic peptide
EAFHKFQEDR

SEQ ID NO: 601 - protein, 9 aa, Artificial Sequence
  Description of Artificial Sequence: Synthetic peptide
CPRPDAKDR

SEQ ID NO: 602 - protein, 26 aa, Artificial Sequence
  Description of Artificial Sequence: Synthetic peptide
AHCAISLEHMHLKPFAFSSPLNNNEK

SEQ ID NO: 603 - protein, 18 aa, Artificial Sequence
  Description of Artificial Sequence: Synthetic peptide
TSANVDIFIKTTDSVQHK

SEQ ID NO: 604 - protein, 19 aa, Artificial Sequence
  Description of Artificial Sequence: Synthetic peptide
TTDSVQHKAGTFAVLGGSK

SEQ ID NO: 605 - protein, 8 aa, Artificial Sequence
  Description of Artificial Sequence: Synthetic peptide
VKFDKVPR

SEQ ID NO: 606 - protein, 5 aa, Artificial Sequence
  Description of Artificial Sequence: Synthetic peptide
KNVDR

SEQ ID NO: 607 - protein, 7 aa, Artificial Sequence
  Description of Artificial Sequence: Synthetic peptide
KALALLK

SEQ ID NO: 608 - protein, 19 aa, Artificial Sequence
  Description of Artificial Sequence: Synthetic peptide
EDKSAGGFQQLGAFHGEPK

SEQ ID NO: 609 - protein, 25 aa, Artificial Sequence
  Description of Artificial Sequence: Synthetic peptide
SAGGFQQLGAFHGEPKWCPSPEASK

SEQ ID NO: 610 - protein, 37 aa, Artificial Sequence; identical to SEQ ID NO: 176
  Description of Artificial Sequence: Synthetic polypeptide

SEQ ID NO: 611 - protein, 18 aa, Artificial Sequence
  Description of Artificial Sequence: Synthetic peptide
HNPWFDGHIDTVDKTTTR

SEQ ID NO: 612 - protein, 20 aa, Artificial Sequence
  Description of Artificial Sequence: Synthetic peptide
SVQNKLFEQPEFGHYTSIAK

SEQ ID NO: 613 - protein, 15 aa, Artificial Sequence
  Description of Artificial Sequence: Synthetic peptide
GKPYNVANCAVTSMR

SEQ ID NO: 614 - protein, 6 aa, Artificial Sequence
  Description of Artificial Sequence: Synthetic peptide
KLEAIK

SEQ ID NO: 615 - protein, 13 aa, Artificial Sequence
  Description of Artificial Sequence: Synthetic peptide
DLFKQPSVIHEPR

SEQ ID NO: 616 - protein, 15 aa, Artificial Sequence
  Description of Artificial Sequence: Synthetic peptide
KNIENLSLGELESLR

SEQ ID NO: 617 - protein, 13 aa, Artificial Sequence
  Description of Artificial Sequence: Synthetic peptide
LYVVVVENALLKK

SEQ ID NO: 618 - protein, 23 aa, Artificial Sequence
  Description of Artificial Sequence: Synthetic peptide
QHHYETNPFHHGKITHENEITTR

SEQ ID NO: 619 - protein, 5 aa, Artificial Sequence
  Description of Artificial Sequence: Synthetic peptide
KRPYR

SEQ ID NO: 620 - protein, 8 aa, Artificial Sequence
  Description of Artificial Sequence: Synthetic peptide
LDITKALK

SEQ ID NO: 621 - protein, 8 aa, Artificial Sequence
  Description of Artificial Sequence: Synthetic peptide
KDITQLDK

SEQ ID NO: 622 - protein, 9 aa, Artificial Sequence
  Description of Artificial Sequence: Synthetic peptide
KDITQLDKR

SEQ ID NO: 623 - protein, 29 aa, Artificial Sequence
  Description of Artificial Sequence: Synthetic peptide
ADHSSDGFQAIASFHALPPLCPSPAASKR

SEQ ID NO: 624 - protein, 17 aa, Artificial Sequence
  Description of Artificial Sequence: Synthetic peptide
KHGAVVGLPYWDWTLPR

SEQ ID NO: 625 - protein, 26 aa, Artificial Sequence
  Description of Artificial Sequence: Synthetic peptide
TAGDCEDAGYFTVLGGEKEMPWAFDR

SEQ ID NO: 626 - protein, 33 aa, Artificial Sequence
  Description of Artificial Sequence: Synthetic polypeptide
HGSSVAVPYWDWTKPIHNIPHLFTDKEYYDVWR

SEQ ID NO: 627 - protein, 10 aa, Artificial Sequence
  Description of Artificial Sequence: Synthetic peptide
NKVMPNPFAR

SEQ ID NO: 628 - protein, 10 aa, Artificial Sequence
  Description of Artificial Sequence: Synthetic peptide
KHAVPNDVFK

SEQ ID NO: 629 - protein, 29 aa, Artificial Sequence
  Description of Artificial Sequence: Synthetic peptide
TSADVQFQICKTSEDCHHGGQIFVLGGTK

SEQ ID NO: 630 - protein, 9 aa, Artificial Sequence
  Description of Artificial Sequence: Synthetic peptide
DKLFNDPER

SEQ ID NO: 631 - protein, 30 aa, Artificial Sequence; identical to SEQ ID NO: 202
  Description of Artificial Sequence: Synthetic polypeptide

SEQ ID NO: 632 - protein, 8 aa, Artificial Sequence
  Description of Artificial Sequence: Synthetic peptide
KLEHELEK

SEQ ID NO: 633 - protein, 6 aa, Artificial Sequence
  Description of Artificial Sequence: Synthetic peptide
QKEEDR

SEQ ID NO: 634 - protein, 15 aa, Artificial Sequence
  Description of Artificial Sequence: Synthetic peptide
IIDTSGKQLPSDLIK

SEQ ID NO: 635 - protein, 16 aa, Artificial Sequence
  Description of Artificial Sequence: Synthetic peptide
HHEKHHEDHHEDILVR

SEQ ID NO: 636 - protein, 15 aa, Artificial Sequence
  Description of Artificial Sequence: Synthetic peptide
KNIHSLSHHEAEELR

SEQ ID NO: 637 - protein, 31 aa, Artificial Sequence; identical to SEQ ID NO: 208
  Description of Artificial Sequence: Synthetic polypeptide

SEQ ID NO: 638 - protein, 30 aa, Artificial Sequence
  Description of Artificial Sequence: Synthetic polypeptide
LQNDESHGGYEHIAGFHGYPNLCPEKGDEK

SEQ ID NO: 639 - protein, 30 aa, Artificial Sequence; identical to SEQ ID NO: 638
  Description of Artificial Sequence: Synthetic polypeptide

SEQ ID NO: 640 - protein, 35 aa, Artificial Sequence
  Description of Artificial Sequence: Synthetic polypeptide
KHGSHLGIPYWDWTQTISSLPTFFADSGNNNPFFK

SEQ ID NO: 641 - protein, 33 aa, Artificial Sequence; identical to SEQ ID NO: 13
  Description of Artificial Sequence: Synthetic polypeptide

SEQ ID NO: 642 - protein, 23 aa, Artificial Sequence
  Description of Artificial Sequence: Synthetic peptide
FNYKYDNLNLHGHNIEELEEVLR

SEQ ID NO: 643 - protein, 10 aa, Artificial Sequence
  Description of Artificial Sequence: Synthetic peptide
TTAVVKVYIK

SEQ ID NO: 644 - protein, 19 aa, Artificial Sequence
  Description of Artificial Sequence: Synthetic peptide
KYDHTELDASVLPAPIIVR

SEQ ID NO: 645 - protein, 23 aa, Artificial Sequence
  Description of Artificial Sequence: Synthetic peptide
RPNNAVFDIIEIPIGKDVNLPPK

SEQ ID NO: 646 - protein, 29 aa, Artificial Sequence
  Description of Artificial Sequence: Synthetic peptide
KGFTDPPVKHHQSANLLVRKNINDLTREE

SEQ ID NO: 647 - protein, 29 aa, Artificial Sequence
  Description of Artificial Sequence: Synthetic peptide
KGFTDPPVKHHQSANLLVRKNINDLTREE

SEQ ID NO: 648 - protein, 19 aa, Artificial Sequence
  Description of Artificial Sequence: Synthetic peptide
AFHKFQEDRSVDGYQATAE

SEQ ID NO: 649 - protein, 19 aa, Artificial Sequence
  Description of Artificial Sequence: Synthetic peptide
VDGTKLASSLIPHASVIRE

SEQ ID NO: 650 - protein, 24 aa, Artificial Sequence
  Description of Artificial Sequence: Synthetic peptide
DKSAGGFQQLGAFHGEPKWCPSPE

SEQ ID NO: 651 - protein, 17 aa, Artificial Sequence
  Description of Artificial Sequence: Synthetic peptide
HSVPFNVFDYKTNFNYE

SEQ ID NO: 652 - protein, 14 aa, Artificial Sequence
  Description of Artificial Sequence: Synthetic peptide
FNGLSISQLNKKLE

SEQ ID NO: 653 - protein, 31 aa, Artificial Sequence; identical to SEQ ID NO: 224
  Description of Artificial Sequence: Synthetic polypeptide

SEQ ID NO: 654 - protein, 29 aa, Artificial Sequence
  Description of Artificial Sequence: Synthetic peptide
VFDLKPASLGKDLFKQPSVIHEPRIGHHE

SEQ ID NO: 655 - protein, 17 aa, Artificial Sequence
  Description of Artificial Sequence: Synthetic peptide
ITQLDKRQQLSLVKALE

SEQ ID NO: 656 - protein, 28 aa, Artificial Sequence
  Description of Artificial Sequence: Synthetic peptide
LLTVSTIHDPETGRDIPNPFIGSKIEFE

SEQ ID NO: 657 - protein, 11 aa, Artificial Sequence
  Description of Artificial Sequence: Synthetic peptide
TLDKMNLRHDE

SEQ ID NO: 658 - protein, 12 aa, Artificial Sequence
  Description of Artificial Sequence: Synthetic peptide
IGGMNLHEIEKE

SEQ ID NO: 659 - protein, 15 aa, Artificial Sequence
  Description of Artificial Sequence: Synthetic peptide
AEELRDALYKLQNDE

SEQ ID NO: 660 - protein, 8 aa, Artificial Sequence
  Description of Artificial Sequence: Synthetic peptide
LGKMYSVE

SEQ ID NO: 661 - protein, 10 aa, Artificial Sequence
  Description of Artificial Sequence: Synthetic peptide
VLGGPSEMKW

SEQ ID NO: 662 - protein, 7 aa, Artificial Sequence
  Description of Artificial Sequence: Synthetic peptide
TVKAELF

SEQ ID NO: 663 - protein, 20 aa, Artificial Sequence
  Description of Artificial Sequence: Synthetic peptide
VRKNINDLTREEVLNLREAF

SEQ ID NO: 664 - protein, 12 aa, Artificial Sequence
  Description of Artificial Sequence: Synthetic peptide
HKFQEDRSVDGY

SEQ ID NO: 665 - protein, 22 aa, Artificial Sequence
  Description of Artificial Sequence: Synthetic peptide
GGISLENIEKMIHENQQEDRIY

SEQ ID NO: 666 - protein, 12 aa, Artificial Sequence
  Description of Artificial Sequence: Synthetic peptide
ALLKEDKSAGGF

SEQ ID NO: 667 - protein, 9 aa, Artificial Sequence
  Description of Artificial Sequence: Synthetic peptide
TSIAKQVLL

SEQ ID NO: 668 - protein, 6 aa, Artificial Sequence
  Description of Artificial Sequence: Synthetic peptide
QALQKY

SEQ ID NO: 669 - protein, 12 aa, Artificial Sequence
  Description of Artificial Sequence: Synthetic peptide
DLKPASLGKDLF

SEQ ID NO: 670 - protein, 6 aa, Artificial Sequence
  Description of Artificial Sequence: Synthetic peptide
ESIAKF

SEQ ID NO: 671 - protein, 8 aa, Artificial Sequence
  Description of Artificial Sequence: Synthetic peptide
KLDITKAL

SEQ ID NO: 672 - protein, 7 aa, Artificial Sequence
  Description of Artificial Sequence: Synthetic peptide
VGGKEPY

SEQ ID NO: 673 - protein, 16 aa, Artificial Sequence
  Description of Artificial Sequence: Synthetic peptide
NLNDHTHDFSKPEDTF

SEQ ID NO: 674 - protein, 21 aa, Artificial Sequence
  Description of Artificial Sequence: Synthetic peptide
NLNDHTHDFSKPEDTFDYQKF

SEQ ID NO: 675 - protein, 11 aa, Artificial Sequence
  Description of Artificial Sequence: Synthetic peptide
TVLGGEKEMPW

SEQ ID NO: 676 - protein, 10 aa, Artificial Sequence
  Description of Artificial Sequence: Synthetic peptide
SERDIGSLKY

SEQ ID NO: 677 - protein, 7 aa, Artificial Sequence
  Description of Artificial Sequence: Synthetic peptide
KYELLGY

SEQ ID NO: 678 - protein, 25 aa, Artificial Sequence
  Description of Artificial Sequence: Synthetic peptide
KYDITHALHDAHITPEDVFHPSEPF

SEQ ID NO: 679 - protein, 13 aa, Artificial Sequence
  Description of Artificial Sequence: Synthetic peptide
THSNAKPTDVFEY

SEQ ID NO: 680 - protein, 17 aa, Artificial Sequence
  Description of Artificial Sequence: Synthetic peptide
KLQNDESHGGYEHIAGF

SEQ ID NO: 681 - protein, 12 aa, Artificial Sequence
  Description of Artificial Sequence: Synthetic peptide
ADSGNNNPFFKY

SEQ ID NO: 682 - protein, 15 aa, Artificial Sequence
  Description of Artificial Sequence: Synthetic peptide
IKSGTDSDDEYAGSF

SEQ ID NO: 683 - protein, 11 aa, Artificial Sequence
  Description of Artificial Sequence: Synthetic peptide
VILGGAKEMPW

SEQ ID NO: 684 - protein, 9 aa, Artificial Sequence
  Description of Artificial Sequence: Synthetic peptide
MTPEELKTY

SEQ ID NO: 685 - protein, 19 aa, Artificial Sequence
  Description of Artificial Sequence: Synthetic peptide
VCIPDDNDRNDDHCEKAGD

SEQ ID NO: 686 - protein, 11 aa, Artificial Sequence
  Description of Artificial Sequence: Synthetic peptide
VLGGPSEMKWQ

SEQ ID NO: 687 - protein, 7 aa, Artificial Sequence
  Description of Artificial Sequence: Synthetic peptide
LSDTVHK

SEQ ID NO: 688 - protein, 9 aa, Artificial Sequence
  Description of Artificial Sequence: Synthetic peptide
VVVHHPEKG

SEQ ID NO: 689 - protein, 11 aa, Artificial Sequence
  Description of Artificial Sequence: Synthetic peptide
FTDPPVKHHQS

SEQ ID NO: 690 - protein, 9 aa, Artificial Sequence
  Description of Artificial Sequence: Synthetic peptide
ISLENIEKM

SEQ ID NO: 691 - protein, 10 aa, Artificial Sequence
  Description of Artificial Sequence: Synthetic peptide
VDITEVDGTK

SEQ ID NO: 692 - protein, 7 aa, Artificial Sequence
  Description of Artificial Sequence: Synthetic peptide
LLKEDKS

SEQ ID NO: 693 - protein, 12 aa, Artificial Sequence
  Description of Artificial Sequence: Synthetic peptide
FHGEPKWCPSPE

SEQ ID NO: 694 - protein, 7 aa, Artificial Sequence
  Description of Artificial Sequence: Synthetic peptide
LADHEKY

SEQ ID NO: 695 - protein, 8 aa, Artificial Sequence
  Description of Artificial Sequence: Synthetic peptide
VTKEHSVP

SEQ ID NO: 696 - protein, 7 aa, Artificial Sequence
  Description of Artificial Sequence: Synthetic peptide
VFDYKTN

SEQ ID NO: 697 - protein, 11 aa, Artificial Sequence
  Description of Artificial Sequence: Synthetic peptide
VAVPYWDWTKR

SEQ ID NO: 698 - protein, 9 aa, Artificial Sequence
  Description of Artificial Sequence: Synthetic peptide
LLGGKGKYS

SEQ ID NO: 699 - protein, 14 aa, Artificial Sequence
  Description of Artificial Sequence: Synthetic peptide
FDKSDNNDEATKTH

SEQ ID NO: 700 - protein, 9 aa, Artificial Sequence
  Description of Artificial Sequence: Synthetic peptide
WVGGKEPYG

SEQ ID NO: 701 - protein, 12 aa, Artificial Sequence
  Description of Artificial Sequence: Synthetic peptide
FSKPEDTFDYQK

SEQ ID NO: 702 - protein, 12 aa, Artificial Sequence
  Description of Artificial Sequence: Synthetic peptide
FSKPEDTFDYQK

SEQ ID NO: 703 - protein, 9 aa, Artificial Sequence
  Description of Artificial Sequence: Synthetic peptide
VLGGEKEMP

SEQ ID NO: 704 - protein, 5 aa, Artificial Sequence
  Description of Artificial Sequence: Synthetic peptide
LDKMN

SEQ ID NO: 705 - protein, 11 aa, Artificial Sequence
  Description of Artificial Sequence: Synthetic peptide
VAVPYWDWTKP

SEQ ID NO: 706 - protein, 7 aa, Artificial Sequence
  Description of Artificial Sequence: Synthetic peptide
LHEIEKE

SEQ ID NO: 707 - protein, 13 aa, Artificial Sequence
  Description of Artificial Sequence: Synthetic peptide
ICKTSEDCHHGGQ

SEQ ID NO: 708 - protein, 12 aa, Artificial Sequence
  Description of Artificial Sequence: Synthetic peptide
LTTAEVDNLKDA

SEQ ID NO: 709 - protein, 10 aa, Artificial Sequence
  Description of Artificial Sequence: Synthetic peptide
FTHSNAKPTD

SEQ ID NO: 710 - protein, 10 aa, Artificial Sequence
  Description of Artificial Sequence: Synthetic peptide
LEKQKEEDRT

SEQ ID NO: 711 - protein, 13 aa, Artificial Sequence
  Description of Artificial Sequence: Synthetic peptide
IIDTSGKQLPSDL

SEQ ID NO: 712 - protein, 6 aa, Artificial Sequence
  Description of Artificial Sequence: Synthetic peptide
LIKMPT

SEQ ID NO: 713 - protein, 6 aa, Artificial Sequence
  Description of Artificial Sequence: Synthetic peptide
IFQQTK

SEQ ID NO: 714 - protein, 9 aa, Artificial Sequence
  Description of Artificial Sequence: Synthetic peptide
LIGGAEKYS

SEQ ID NO: 715 - protein, 15 aa, Artificial Sequence
  Description of Artificial Sequence: Synthetic peptide
IKSGTDSDDEYAGSF

SEQ ID NO: 716 - protein, 10 aa, Artificial Sequence
  Description of Artificial Sequence: Synthetic peptide
VILGGAKEMP

SEQ ID NO: 717 - protein, 7 aa, Artificial Sequence
  Description of Artificial Sequence: Synthetic peptide
LTDDHVK

SEQ ID NO: 718 - protein, 16 aa, Artificial Sequence
  Description of Artificial Sequence: Synthetic peptide
KNVDSLSSDEVLALEK

SEQ ID NO: 719 - protein, 9 aa, Artificial Sequence
  Description of Artificial Sequence: Synthetic peptide
ADITFLNKK

SEQ ID NO: 720 - protein, 12 aa, Artificial Sequence
  Description of Artificial Sequence: Synthetic peptide
LFEKVQPGHHTR

SEQ ID NO: 721 - protein, 23 aa, Artificial Sequence
  Description of Artificial Sequence: Synthetic peptide
GKDPNSADCAHNLIHTPMEPFDR

SEQ ID NO: 722 - protein, 13 aa, Artificial Sequence
  Description of Artificial Sequence: Synthetic peptide
EHAKPADSFDYGR

SEQ ID NO: 723 - protein, 19 aa, Artificial Sequence
  Description of Artificial Sequence: Synthetic peptide
AGDFFLLGGPTEMKWGFYR

SEQ ID NO: 724 - protein, 28 aa, Artificial Sequence
  Description of Artificial Sequence: Synthetic peptide
QPTLVHRPAKGHFDKPPVPVAQANLAVR

SEQ ID NO: 725 - protein, 18 aa, Artificial Sequence
  Description of Artificial Sequence: Synthetic peptide
GHFDKPPVPVAQANLAVR

SEQ ID NO: 726 - protein, 22 aa, Artificial Sequence
  Description of Artificial Sequence: Synthetic peptide
FQNDKSVDGYQATVEFHALPAR

SEQ ID NO: 727 - protein, 9 aa, Artificial Sequence
  Description of Artificial Sequence: Synthetic peptide
CPRPDAKDR

SEQ ID NO: 728 - protein, 15 aa, Artificial Sequence
  Description of Artificial Sequence: Synthetic peptide
KHGFTGGLPYWDWTR

SEQ ID NO: 729 - protein, 15 aa, Artificial Sequence
  Description of Artificial Sequence: Synthetic peptide
GKPYNTANCAIASMR

SEQ ID NO: 730 - protein, 19 aa, Artificial Sequence
  Description of Artificial Sequence: Synthetic peptide
KPLQPFGLDSVINPDDETR

SEQ ID NO: 731 - protein, 27 aa, Artificial Sequence
  Description of Artificial Sequence: Synthetic peptide
VFDYKNNFDYEYESLAFNGLSIAQLDR

SEQ ID NO: 732 - protein, 17 aa, Artificial Sequence
  Description of Artificial Sequence: Synthetic peptide
SAFLQIQKEGIYENIAK

SEQ ID NO: 733 - protein, 31 aa, Artificial Sequence; identical to SEQ ID NO: 25
  Description of Artificial Sequence: Synthetic polypeptide

SEQ ID NO: 734 - protein, 42 aa, Artificial Sequence; identical to SEQ ID NO: 308
  Description of Artificial Sequence: Synthetic polypeptide

SEQ ID NO: 735 - protein, 26 aa, Artificial Sequence
  Description of Artificial Sequence: Synthetic peptide
AKYSLSSLDYTAFDPVFFLHHANVDR

SEQ ID NO: 736 - protein, 15 aa, Artificial Sequence
  Description of Artificial Sequence: Synthetic peptide
KKPYNEADCAVNEMR

SEQ ID NO: 737 - protein, 32 aa, Artificial Sequence; identical to SEQ ID NO: 27
  Description of Artificial Sequence: Synthetic polypeptide

SEQ ID NO: 738 - protein, 23 aa, Artificial Sequence
  Description of Artificial Sequence: Synthetic peptide
YQYDNLQFNHFSIQKLDQTIQAR

SEQ ID NO: 739 - protein, 12 aa, Artificial Sequence
  Description of Artificial Sequence: Synthetic peptide
LYTVQFEDSLKR

SEQ ID NO: 740 - protein, 15 aa, Artificial Sequence
  Description of Artificial Sequence: Synthetic peptide
TQEFSKPEDTFDYHR

SEQ ID NO: 741 - protein, 8 aa, Artificial Sequence
  Description of Artificial Sequence: Synthetic peptide
YDITKTLK

SEQ ID NO: 742 - protein, 12 aa, Artificial Sequence
  Description of Artificial Sequence: Synthetic peptide
YDDTFTIKVHIK

SEQ ID NO: 743 - protein, 12 aa, Artificial Sequence
  Description of Artificial Sequence: Synthetic peptide
GYIKSEDAYTVR

SEQ ID NO: 744 - protein, 15 aa, Artificial Sequence
  Description of Artificial Sequence: Synthetic peptide
KDVTSLTASEIENLR

SEQ ID NO: 745 - protein, 10 aa, Artificial Sequence
  Description of Artificial Sequence: Synthetic peptide
QPLKPFSESR

SEQ ID NO: 746 - protein, 8 aa, Artificial Sequence
  Description of Artificial Sequence: Synthetic peptide
YDITKVLK

SEQ ID NO: 747 - protein, 8 aa, Artificial Sequence
  Description of Artificial Sequence: Synthetic peptide
KKPYNAAK

SEQ ID NO: 748 - protein, 24 aa, Artificial Sequence
  Description of Artificial Sequence: Synthetic peptide
KPPVPVAQANLAVRKNINDLTAEE

SEQ ID NO: 749 - protein, 16 aa, Artificial Sequence
  Description of Artificial Sequence: Synthetic peptide
RFQNDKSVDGYQATVE

SEQ ID NO: 750 - protein, 21 aa, Artificial Sequence
  Description of Artificial Sequence: Synthetic peptide
ITQQLHDLDLHVGDNFFLKYE

SEQ ID NO: 751 - protein, 12 aa, Artificial Sequence
  Description of Artificial Sequence: Synthetic peptide
SIRSAFLQIQKE

SEQ ID NO: 752 - protein, 13 aa, Artificial Sequence
  Description of Artificial Sequence: Synthetic peptide
NIAKFHGKPGLCE

SEQ ID NO: 753 - protein, 20 aa, Artificial Sequence
  Description of Artificial Sequence: Synthetic peptide
NAVTSRDPQPELWDNKDFYE

SEQ ID NO: 754 - protein, 16 aa, Artificial Sequence
  Description of Artificial Sequence: Synthetic peptide
FSKPEDTFDYHRFGYE

SEQ ID NO: 755 - protein, 8 aa, Artificial Sequence
  Description of Artificial Sequence: Synthetic peptide
APFFIKVE

SEQ ID NO: 756 - protein, 20 aa, Artificial Sequence
  Description of Artificial Sequence: Synthetic peptide
LDHAYSLRDGHYYIAGPTKD

SEQ ID NO: 757 - protein, 18 aa, Artificial Sequence
  Description of Artificial Sequence: Synthetic peptide
ALEKALDDLQQDDSNQGY

SEQ ID NO: 758 - protein, 20 aa, Artificial Sequence
  Description of Artificial Sequence: Synthetic peptide
DLTREHAKPADSFDYGRLGY

SEQ ID NO: 759 - protein, 10 aa, Artificial Sequence
  Description of Artificial Sequence: Synthetic peptide
LLGGPTEMKW

SEQ ID NO: 760 - protein, 12 aa, Artificial Sequence
  Description of Artificial Sequence: Synthetic peptide
DKPPVPVAQANL

SEQ ID NO: 761 - protein, 7 aa, Artificial Sequence
  Description of Artificial Sequence: Synthetic peptide
VGGSEKY

SEQ ID NO: 762 - protein, 9 aa, Artificial Sequence
  Description of Artificial Sequence: Synthetic peptide
TDIAKQVLL

SEQ ID NO: 763 - protein, 6 aa, Artificial Sequence
  Description of Artificial Sequence: Synthetic peptide
QALQKY

SEQ ID NO: 764 - protein, 10 aa, Artificial Sequence
  Description of Artificial Sequence: Synthetic peptide
DYKNNFDYEY

SEQ ID NO: 765 - protein, 16 aa, Artificial Sequence
  Description of Artificial Sequence: Synthetic peptide
AGFLLHEIGQSALVKF

SEQ ID NO: 766 - protein, 9 aa, Artificial Sequence
  Description of Artificial Sequence: Synthetic peptide
LQIQKEGIY

SEQ ID NO: 767 - protein, 15 aa, Artificial Sequence
  Description of Artificial Sequence: Synthetic peptide
LQIQKEGIYENIAKF

SEQ ID NO: 768 - protein, 11 aa, Artificial Sequence
  Description of Artificial Sequence: Synthetic peptide
DNKDFYENVML

SEQ ID NO: 769 - protein, 15 aa, Artificial Sequence
  Description of Artificial Sequence: Synthetic peptide
KHNLPQDSFDYQNRF

SEQ ID NO: 770 - protein, 18 aa, Artificial Sequence
  Description of Artificial Sequence: Synthetic peptide
ICVEQGGEQNCKTKAGSF

SEQ ID NO: 771 - protein, 18 aa, Artificial Sequence
  Description of Artificial Sequence: Synthetic peptide
ICVEQGGEQNCKTKAGSF

SEQ ID NO: 772 - protein, 7 aa, Artificial Sequence
  Description of Artificial Sequence: Synthetic peptide
TTLEKHF

SEQ ID NO: 773 - protein, 12 aa, Artificial Sequence
  Description of Artificial Sequence: Synthetic peptide
KNMQADDSPDGY

SEQ ID NO: 774 - protein, 9 aa, Artificial Sequence
  Description of Artificial Sequence: Synthetic peptide
SHKTFPNPF

SEQ ID NO: 775 - protein, 11 aa, Artificial Sequence
  Description of Artificial Sequence: Synthetic peptide
IKQQQEADRVF

SEQ ID NO: 776 - protein, 11 aa, Artificial Sequence
  Description of Artificial Sequence: Synthetic peptide
KGFGQSASVSF

SEQ ID NO: 777 - protein, 14 aa, Artificial Sequence
  Description of Artificial Sequence: Synthetic peptide
WDWTKPISKLPDLF

SEQ ID NO: 778 - protein, 7 aa, Artificial Sequence
  Description of Artificial Sequence: Synthetic peptide
IKSEDAY

SEQ ID NO: 779 - protein, 17 aa, Artificial Sequence
  Description of Artificial Sequence: Synthetic peptide
KAQSIHPEDVFDTDAPF

SEQ ID NO: 780 - protein, 27 aa, Artificial Sequence
  Description of Artificial Sequence: Synthetic peptide
SAGEGHTDDHGSDHIAGSGVRKDVTSL

SEQ ID NO: 781 - protein, 7 aa, Artificial Sequence
  Description of Artificial Sequence: Synthetic peptide
KQPLKPF

SEQ ID NO: 782 - protein, 7 aa, Artificial Sequence
  Description of Artificial Sequence: Synthetic peptide
KQPLKPF

SEQ ID NO: 783 - protein, 8 aa, Artificial Sequence
  Description of Artificial Sequence: Synthetic peptide
RYDITKVL

SEQ ID NO: 784 - protein, 8 aa, Artificial Sequence
  Description of Artificial Sequence: Synthetic peptide
TSANVKIY

SEQ ID NO: 785 - protein, 8 aa, Artificial Sequence
  Description of Artificial Sequence: Synthetic peptide
IAGPTKDL

SEQ ID NO: 786 - protein, 7 aa, Artificial Sequence
  Description of Artificial Sequence: Synthetic peptide
VDKHEKN

SEQ ID NO: 787 - protein, 11 aa, Artificial Sequence
  Description of Artificial Sequence: Synthetic peptide
FEKVQPGHHTR

SEQ ID NO: 788 - protein, 12 aa, Artificial Sequence
  Description of Artificial Sequence: Synthetic peptide
ILDALEQDEFCK

SEQ ID NO: 789 - protein, 14 aa, Artificial Sequence
  Description of Artificial Sequence: Synthetic peptide
LRGKDPNSADCAHN

SEQ ID NO: 790 - protein, 11 aa, Artificial Sequence
  Description of Artificial Sequence: Synthetic peptide
AKPADSFDYGR

SEQ ID NO: 791 - protein, 8 aa, Artificial Sequence
  Description of Artificial Sequence: Synthetic peptide
LGGPTEMK

SEQ ID NO: 792 - protein, 7 aa, Artificial Sequence
  Description of Artificial Sequence: Synthetic peptide
FDKPPVP

SEQ ID NO: 793 - protein, 6 aa, Artificial Sequence
  Description of Artificial Sequence: Synthetic peptide
FQNDKS

SEQ ID NO: 794 - protein, 12 aa, Artificial Sequence
  Description of Artificial Sequence: Synthetic peptide
LDPVTGETKNNP

SEQ ID NO: 795 - protein, 8 aa, Artificial Sequence
  Description of Artificial Sequence: Synthetic peptide
VGGSEKYS

SEQ ID NO: 796 - protein, 12 aa, Artificial Sequence
  Description of Artificial Sequence: Synthetic peptide
FHGEPKWCPSPE

SEQ ID NO: 797 - protein, 13 aa, Artificial Sequence
  Description of Artificial Sequence: Synthetic peptide
YWDWTEKADSLPS

SEQ ID NO: 798 - protein, 6 aa, Artificial Sequence
  Description of Artificial Sequence: Synthetic peptide
LWDNKD

SEQ ID NO: 799 - protein, 15 aa, Artificial Sequence
  Description of Artificial Sequence: Synthetic peptide
LKHNLPQDSFDYQNR

SEQ ID NO: 800 - protein, 17 aa, Artificial Sequence
  Description of Artificial Sequence: Synthetic peptide
ICVEQGGEQNCKTKAGS

SEQ ID NO: 801 - protein, 17 aa, Artificial Sequence
  Description of Artificial Sequence: Synthetic peptide
ICVEQGGEQNCKTKAGS

SEQ ID NO: 802 - protein, 10 aa, Artificial Sequence
  Description of Artificial Sequence: Synthetic peptide
FSHKTFPNPF

SEQ ID NO: 803 - protein, 12 aa, Artificial Sequence
  Description of Artificial Sequence: Synthetic peptide
FSKPEDTFDYHR

SEQ ID NO: 804 - protein, 10 aa, Artificial Sequence
  Description of Artificial Sequence: Synthetic peptide
IKQQQEADRV

SEQ ID NO: 805 - protein, 7 aa, Artificial Sequence
  Description of Artificial Sequence: Synthetic peptide
YWDWTKP

SEQ ID NO: 806 - protein, 7 aa, Artificial Sequence
  Description of Artificial Sequence: Synthetic peptide
ISKLPDL

SEQ ID NO: 807 - protein, 5 aa, Artificial Sequence
  Description of Artificial Sequence: Synthetic peptide
FAKGY

SEQ ID NO: 808 - protein, 5 aa, Artificial Sequence
  Description of Artificial Sequence: Synthetic peptide
FTKMH

SEQ ID NO: 809 - protein, 10 aa, Artificial Sequence
  Description of Artificial Sequence: Synthetic peptide
LDEANDLKNA

SEQ ID NO: 810 - protein, 7 aa, Artificial Sequence
  Description of Artificial Sequence: Synthetic peptide
LKEHGSH

SEQ ID NO: 811 - protein, 7 aa, Artificial Sequence
  Description of Artificial Sequence: Synthetic peptide
YWDWTKS

SEQ ID NO: 812 - protein, 7 aa, Artificial Sequence
  Description of Artificial Sequence: Synthetic peptide
IAGPTKD

SEQ ID NO: 813 - protein, 18 aa, Artificial Sequence
  Description of Artificial Sequence: Synthetic peptide
GFTDPPVKHHQSANLLVR

SEQ ID NO: 814 - protein, 8 aa, Artificial Sequence
  Description of Artificial Sequence: Synthetic peptide
KNINDLTR

SEQ ID NO: 815 - protein, 10 aa, Artificial Sequence
  Description of Artificial Sequence: Synthetic peptide
EAFHKFQEDR

SEQ ID NO: 816 - protein, 9 aa, Artificial Sequence
  Description of Artificial Sequence: Synthetic peptide
CPRPDAKDR

SEQ ID NO: 817 - protein, 19 aa, Artificial Sequence
  Description of Artificial Sequence: Synthetic peptide
TTDSVQHKAGTFAVLGGSK

SEQ ID NO: 818 - protein, 8 aa, Artificial Sequence
  Description of Artificial Sequence: Synthetic peptide
VKFDKVPR

SEQ ID NO: 819 - protein, 8 aa, Artificial Sequence
  Description of Artificial Sequence: Synthetic peptide
VKFDKVPR

SEQ ID NO: 820 - protein, 5 aa, Artificial Sequence
  Description of Artificial Sequence: Synthetic peptide
KNVDR

SEQ ID NO: 821 - protein, 10 aa, Artificial Sequence
  Description of Artificial Sequence: Synthetic peptide
KALALLKEDK

SEQ ID NO: 822 - protein, 19 aa, Artificial Sequence
  Description of Artificial Sequence: Synthetic peptide
EDKSAGGFQQLGAFHGEPK

SEQ ID NO: 823 - protein, 25 aa, Artificial Sequence
  Description of Artificial Sequence: Synthetic peptide
SAGGFQQLGAFHGEPKWCPSPEASK

SEQ ID NO: 824 - protein, 37 aa, Artificial Sequence; identical to SEQ ID NO: 176
  Description of Artificial Sequence: Synthetic polypeptide

SEQ ID NO: 825 - protein, 18 aa, Artificial Sequence
  Description of Artificial Sequence: Synthetic peptide
HNPWFDGHIDTVDKTTTR

SEQ ID NO: 826 - protein, 20 aa, Artificial Sequence
  Description of Artificial Sequence: Synthetic peptide
SVQNKLFEQPEFGHYTSIAK

SEQ ID NO: 827 - protein, 15 aa, Artificial Sequence
  Description of Artificial Sequence: Synthetic peptide
GKPYNVANCAVTSMR

SEQ ID NO: 828 - protein, 13 aa, Artificial Sequence
  Description of Artificial Sequence: Synthetic peptide
DLFKQPSVIHEPR

SEQ ID NO: 829 - protein, 15 aa, Artificial Sequence
  Description of Artificial Sequence: Synthetic peptide
KNIENLSLGELESLR

SEQ ID NO: 830 - protein, 13 aa, Artificial Sequence
  Description of Artificial Sequence: Synthetic peptide
LYVVVVENALLKK

SEQ ID NO: 831 - protein, 23 aa, Artificial Sequence
  Description of Artificial Sequence: Synthetic peptide
QHHYETNPFHHGKITHENEITTR

SEQ ID NO: 832 - protein, 5 aa, Artificial Sequence
  Description of Artificial Sequence: Synthetic peptide
KRPYR

SEQ ID NO: 833 - protein, 9 aa, Artificial Sequence
  Description of Artificial Sequence: Synthetic peptide
KDITQLDKR

SEQ ID NO: 834 - protein, 9 aa, Artificial Sequence
  Description of Artificial Sequence: Synthetic peptide
KDITQLDKR

SEQ ID NO: 835 - protein, 17 aa, Artificial Sequence
  Description of Artificial Sequence: Synthetic peptide
KHGAVVGLPYWDWTLPR

SEQ ID NO: 836 - protein, 26 aa, Artificial Sequence
  Description of Artificial Sequence: Synthetic peptide
TAGDCEDAGYFTVLGGEKEMPWAFDR

SEQ ID NO: 837 - protein, 12 aa, Artificial Sequence
  Description of Artificial Sequence: Synthetic peptide
LYKYDITETLDK

SEQ ID NO: 838 - protein, 33 aa, Artificial Sequence; identical to SEQ ID NO: 626
  Description of Artificial Sequence: Synthetic polypeptide

SEQ ID NO: 839 - protein, 10 aa, Artificial Sequence
  Description of Artificial Sequence: Synthetic peptide
NKVMPNPFAR

SEQ ID NO: 840 - protein, 10 aa, Artificial Sequence
  Description of Artificial Sequence: Synthetic peptide
EIKDKQHHVR

SEQ ID NO: 841 - protein, 29 aa, Artificial Sequence
  Description of Artificial Sequence: Synthetic peptide
TSADVQFQICKTSEDCHHGGQIFVLGGTK

SEQ ID NO: 842 - protein, 9 aa, Artificial Sequence
  Description of Artificial Sequence: Synthetic peptide
DKLFNDPER

SEQ ID NO: 843 - protein, 8 aa, Artificial Sequence
  Description of Artificial Sequence: Synthetic peptide
KLEHELEK

SEQ ID NO: 844 - protein, 6 aa, Artificial Sequence
  Description of Artificial Sequence: Synthetic peptide
QKEEDR

SEQ ID NO: 845 - protein, 16 aa, Artificial Sequence
  Description of Artificial Sequence: Synthetic peptide
HHEKHHEDHHEDILVR

SEQ ID NO: 846 - protein, 15 aa, Artificial Sequence
  Description of Artificial Sequence: Synthetic peptide
KNIHSLSHHEAEELR

SEQ ID NO: 847 - protein, 30 aa, Artificial Sequence; identical to SEQ ID NO: 638
  Description of Artificial Sequence: Synthetic polypeptide

SEQ ID NO: 848 - protein, 33 aa, Artificial Sequence; identical to SEQ ID NO: 13
  Description of Artificial Sequence: Synthetic polypeptide

SEQ ID NO: 849 - protein, 23 aa, Artificial Sequence
  Description of Artificial Sequence: Synthetic peptide
FNYKYDNLNLHGHNIEELEEVLR

SEQ ID NO: 850 - protein, 19 aa, Artificial Sequence
  Description of Artificial Sequence: Synthetic peptide
KYDHTELDASVLPAPIIVR

SEQ ID NO: 851 - protein, 29 aa, Artificial Sequence
  Description of Artificial Sequence: Synthetic peptide
KGFTDPPVKHHQSANLLVRKNINDLTREE

SEQ ID NO: 852 - protein, 29 aa, Artificial Sequence
  Description of Artificial Sequence: Synthetic peptide
KGFTDPPVKHHQSANLLVRKNINDLTREE

SEQ ID NO: 853 - protein, 19 aa, Artificial Sequence
  Description of Artificial Sequence: Synthetic peptide
AFHKFQEDRSVDGYQATAE

SEQ ID NO: 854 - protein, 8 aa, Artificial Sequence
  Description of Artificial Sequence: Synthetic peptide
NIEKMIHE

SEQ ID NO: 855 - protein, 19 aa, Artificial Sequence
  Description of Artificial Sequence: Synthetic peptide
VDGTKLASSLIPHASVIRE

SEQ ID NO: 856 - protein, 24 aa, Artificial Sequence
  Description of Artificial Sequence: Synthetic peptide
DKSAGGFQQLGAFHGEPKWCPSPE

SEQ ID NO: 857 - protein, 24 aa, Artificial Sequence
  Description of Artificial Sequence: Synthetic peptide
DKSAGGFQQLGAFHGEPKWCPSPE

SEQ ID NO: 858 - protein, 17 aa, Artificial Sequence
  Description of Artificial Sequence: Synthetic peptide
HSVPFNVFDYKTNFNYE

SEQ ID NO: 859 - protein, 14 aa, Artificial Sequence
  Description of Artificial Sequence: Synthetic peptide
FNGLSISQLNKKLE

SEQ ID NO: 860 - protein, 29 aa, Artificial Sequence
  Description of Artificial Sequence: Synthetic peptide
VFDLKPASLGKDLFKQPSVIHEPRIGHHE

SEQ ID NO: 861 - protein, 22 aa, Artificial Sequence
  Description of Artificial Sequence: Synthetic peptide
NALLKKGSSVAVPYWDWTKRIE

SEQ ID NO: 862 - protein, 22 aa, Artificial Sequence
  Description of Artificial Sequence: Synthetic peptide
NALLKKGSSVAVPYWDWTKRIE

SEQ ID NO: 863 - protein, 14 aa, Artificial Sequence
  Description of Artificial Sequence: Synthetic peptide
TNPFHHGKITHENE

SEQ ID NO: 864 - protein, 21 aa, Artificial Sequence
  Description of Artificial Sequence: Synthetic peptide
AGTDSAHTDDGHTEPVMIRKD

SEQ ID NO: 865 - protein, 17 aa, Artificial Sequence
  Description of Artificial Sequence: Synthetic peptide
ITQLDKRQQLSLVKALE

SEQ ID NO: 866 - protein, 17 aa, Artificial Sequence
  Description of Artificial Sequence: Synthetic peptide
ITQLDKRQQLSLVKALE

SEQ ID NO: 867 - protein, 17 aa, Artificial Sequence
  Description of Artificial Sequence: Synthetic peptide
TGRDIPNPFIGSKIEFE

SEQ ID NO: 868 - protein, 11 aa, Artificial Sequence
  Description of Artificial Sequence: Synthetic peptide
TLDKMNLRHDE

SEQ ID NO: 869 - protein, 20 aa, Artificial Sequence
  Description of Artificial Sequence: Synthetic peptide
INHNQFTKKHAVPNDVFKYE

SEQ ID NO: 870 - protein, 12 aa, Artificial Sequence
  Description of Artificial Sequence: Synthetic peptide
IGGMNLHEIEKE

SEQ ID NO: 871 - protein, 15 aa, Artificial Sequence
  Description of Artificial Sequence: Synthetic peptide
AEELRDALYKLQNDE

SEQ ID NO: 872 - protein, 10 aa, Artificial Sequence
  Description of Artificial Sequence: Synthetic peptide
AIFQQTKFGE

SEQ ID NO: 873 - protein, 8 aa, Artificial Sequence
  Description of Artificial Sequence: Synthetic peptide
LGKMYSVE

SEQ ID NO: 874 - protein, 7 aa, Artificial Sequence
  Description of Artificial Sequence: Synthetic peptide
TVKAELF

SEQ ID NO: 875 - protein, 14 aa, Artificial Sequence
  Description of Artificial Sequence: Synthetic peptide
IKTTDSVQHKAGTF

SEQ ID NO: 876 - protein, 12 aa, Artificial Sequence
  Description of Artificial Sequence: Synthetic peptide
ALLKEDKSAGGF

SEQ ID NO: 877 - protein, 9 aa, Artificial Sequence
  Description of Artificial Sequence: Synthetic peptide
TSIAKQVLL

SEQ ID NO: 878 - protein, 6 aa, Artificial Sequence
  Description of Artificial Sequence: Synthetic peptide
QALQKY

SEQ ID NO: 879 - protein, 9 aa, Artificial Sequence
  Description of Artificial Sequence: Synthetic peptide
NVFDYKTNF

SEQ ID NO: 880 - protein, 10 aa, Artificial Sequence
  Description of Artificial Sequence: Synthetic peptide
EAIKSQDRFF

SEQ ID NO: 881 - protein, 19 aa, Artificial Sequence
  Description of Artificial Sequence: Synthetic peptide
KQPSVIHEPRIGHHEGEVY

SEQ ID NO: 882 - protein, 8 aa, Artificial Sequence
  Description of Artificial Sequence: Synthetic peptide
KLDITKAL

SEQ ID NO: 883 - protein, 7 aa, Artificial Sequence
  Description of Artificial Sequence: Synthetic peptide
VGGKEPY

SEQ ID NO: 884 - protein, 16 aa, Artificial Sequence
  Description of Artificial Sequence: Synthetic peptide
NLNDHTHDFSKPEDTF

SEQ ID NO: 885 - protein, 10 aa, Artificial Sequence
  Description of Artificial Sequence: Synthetic peptide
SERDIGSLKY

SEQ ID NO: 886 - protein, 7 aa, Artificial Sequence
  Description of Artificial Sequence: Synthetic peptide
KYELLGY

SEQ ID NO: 887 - protein, 13 aa, Artificial Sequence
  Description of Artificial Sequence: Synthetic peptide
THSNAKPTDVFEY

SEQ ID NO: 888 - protein, 11 aa, Artificial Sequence
  Description of Artificial Sequence: Synthetic peptide
KLQNDESHGGY

SEQ ID NO: 889 - protein, 11 aa, Artificial Sequence
  Description of Artificial Sequence: Synthetic peptide
KKHGSHLGIPY

SEQ ID NO: 890 - protein, 7 aa, Artificial Sequence
  Description of Artificial Sequence: Synthetic peptide
IGGAEKY

SEQ ID NO: 891 - protein, 12 aa, Artificial Sequence
  Description of Artificial Sequence: Synthetic peptide
SGIRTTAVVKVY

SEQ ID NO: 892 - protein, 15 aa, Artificial Sequence
  Description of Artificial Sequence: Synthetic peptide
IKSGTDSDDEYAGSF

SEQ ID NO: 893 - protein, 8 aa, Artificial Sequence
  Description of Artificial Sequence: Synthetic peptide
GGAKEMPW

SEQ ID NO: 894 - protein, 9 aa, Artificial Sequence
  Description of Artificial Sequence: Synthetic peptide
MTPEELKTY

SEQ ID NO: 895 - protein, 19 aa, Artificial Sequence
  Description of Artificial Sequence: Synthetic peptide
VCIPDDNDRNDDHCEKAGD

SEQ ID NO: 896 - protein, 11 aa, Artificial Sequence
  Description of Artificial Sequence: Synthetic peptide
VLGGPSEMKWQ

SEQ ID NO: 897 - protein, 7 aa, Artificial Sequence
  Description of Artificial Sequence: Synthetic peptide
LSDTVHK

SEQ ID NO: 898 - protein, 9 aa, Artificial Sequence
  Description of Artificial Sequence: Synthetic peptide
VVVHHPEKG

SEQ ID NO: 899 - protein, 11 aa, Artificial Sequence
  Description of Artificial Sequence: Synthetic peptide
FTDPPVKHHQS

SEQ ID NO: 900 - protein, 9 aa, Artificial Sequence
  Description of Artificial Sequence: Synthetic peptide
ISLENIEKM

SEQ ID NO: 901 - protein, 12 aa, Artificial Sequence
  Description of Artificial Sequence: Synthetic peptide
VTVDITEVDGTK

SEQ ID NO: 902 - protein, 7 aa, Artificial Sequence
  Description of Artificial Sequence: Synthetic peptide
LLKEDKS

SEQ ID NO: 903 - protein, 12 aa, Artificial Sequence
  Description of Artificial Sequence: Synthetic peptide
FHGEPKWCPSPE

SEQ ID NO: 904 - protein, 7 aa, Artificial Sequence
  Description of Artificial Sequence: Synthetic peptide
LADHEKY

SEQ ID NO: 905 - protein, 9 aa, Artificial Sequence
  Description of Artificial Sequence: Synthetic peptide
FNVFDYKTN

SEQ ID NO: 906 - protein, 9 aa, Artificial Sequence
  Description of Artificial Sequence: Synthetic peptide
VPYWDWTKR

SEQ ID NO: 907 - protein, 10 aa, Artificial Sequence
  Description of Artificial Sequence: Synthetic peptide
ITTRDPKDSL

SEQ ID NO: 908 - protein, 14 aa, Artificial Sequence
  Description of Artificial Sequence: Synthetic peptide
FDKSDNNDEATKTH

SEQ ID NO: 909 - protein, 14 aa, Artificial Sequence
  Description of Artificial Sequence: Synthetic peptide
FDKSDNNDEATKTH

SEQ ID NO: 910 - protein, 12 aa, Artificial Sequence
  Description of Artificial Sequence: Synthetic peptide
FSKPEDTFDYQK

SEQ ID NO: 911 - protein, 12 aa, Artificial Sequence
  Description of Artificial Sequence: Synthetic peptide
FSKPEDTFDYQK

SEQ ID NO: 912 - protein, 9 aa, Artificial Sequence
  Description of Artificial Sequence: Synthetic peptide
VLGGEKEMP

SEQ ID NO: 913 - protein, 11 aa, Artificial Sequence
  Description of Artificial Sequence: Synthetic peptide
VAVPYWDWTKP

SEQ ID NO: 914 - protein, 5 aa, Artificial Sequence
  Description of Artificial Sequence: Synthetic peptide
FTKKH

SEQ ID NO: 915 - protein, 7 aa, Artificial Sequence
  Description of Artificial Sequence: Synthetic peptide
LHEIEKE

SEQ ID NO: 916 - protein, 11 aa, Artificial Sequence
  Description of Artificial Sequence: Synthetic peptide
LTTAEVDNLKD

SEQ ID NO: 917 - protein, 16 aa, Artificial Sequence
  Description of Artificial Sequence: Synthetic peptide
FTHSNAKPTDVFEYSR

SEQ ID NO: 918 - protein, 10 aa, Artificial Sequence
  Description of Artificial Sequence: Synthetic peptide
LEKQKEEDRT

SEQ ID NO: 919 - protein, 14 aa, Artificial Sequence
  Description of Artificial Sequence: Synthetic peptide
LEHELEKQKEEDRT

SEQ ID NO: 920 - protein, 12 aa, Artificial Sequence
  Description of Artificial Sequence: Synthetic peptide
IIDTSGKQLPSD

SEQ ID NO: 921 - protein, 6 aa, Artificial Sequence
  Description of Artificial Sequence: Synthetic peptide
LIKMPT

SEQ ID NO: 922 - protein, 6 aa, Artificial Sequence
  Description of Artificial Sequence: Synthetic peptide
IFQQTK

SEQ ID NO: 923 - protein, 9 aa, Artificial Sequence
  Description of Artificial Sequence: Synthetic peptide
LIGGAEKYS

SEQ ID NO: 924 - protein, 15 aa, Artificial Sequence
  Description of Artificial Sequence: Synthetic peptide
IKSGTDSDDEYAGSF

SEQ ID NO: 925 - protein, 10 aa, Artificial Sequence
  Description of Artificial Sequence: Synthetic peptide
VILGGAKEMP

SEQ ID NO: 926 - protein, 7 aa, Artificial Sequence
  Description of Artificial Sequence: Synthetic peptide
LTDDHVK

SEQ ID NO: 927 - protein, 16 aa, Artificial Sequence
  Description of Artificial Sequence: Synthetic peptide
KNVDSLSSDEVLALEK

SEQ ID NO: 928 - protein, 9 aa, Artificial Sequence
  Description of Artificial Sequence: Synthetic peptide
ADITFLNKK

SEQ ID NO: 929 - protein, 12 aa, Artificial Sequence
  Description of Artificial Sequence: Synthetic peptide
LFEKVQPGHHTR

SEQ ID NO: 930 - protein, 23 aa, Artificial Sequence
  Description of Artificial Sequence: Synthetic peptide
GKDPNSADCAHNLIHTPMEPFDR

SEQ ID NO: 931 - protein, 13 aa, Artificial Sequence
  Description of Artificial Sequence: Synthetic peptide
EHAKPADSFDYGR

SEQ ID NO: 932 - protein, 28 aa, Artificial Sequence
  Description of Artificial Sequence: Synthetic peptide
QPTLVHRPAKGHFDKPPVPVAQANLAVR

SEQ ID NO: 933 - protein, 18 aa, Artificial Sequence
  Description of Artificial Sequence: Synthetic peptide
GHFDKPPVPVAQANLAVR

SEQ ID NO: 934 - protein, 22 aa, Artificial Sequence
  Description of Artificial Sequence: Synthetic peptide
FQNDKSVDGYQATVEFHALPAR

SEQ ID NO: 935 - protein, 9 aa, Artificial Sequence
  Description of Artificial Sequence: Synthetic peptide
CPRPDAKDR

SEQ ID NO: 936 - protein, 15 aa, Artificial Sequence
  Description of Artificial Sequence: Synthetic peptide
KHGFTGGLPYWDWTR

SEQ ID NO: 937 - protein, 15 aa, Artificial Sequence
  Description of Artificial Sequence: Synthetic peptide
GKPYNTANCAIASMR

SEQ ID NO: 938 - protein, 19 aa, Artificial Sequence
  Description of Artificial Sequence: Synthetic peptide
KPLQPFGLDSVINPDDETR

SEQ ID NO: 939 - protein, 27 aa, Artificial Sequence
  Description of Artificial Sequence: Synthetic peptide
VFDYKNNFDYEYESLAFNGLSIAQLDR

SEQ ID NO: 940 - protein, 31 aa, Artificial Sequence; identical to SEQ ID NO: 25
  Description of Artificial Sequence: Synthetic polypeptide

SEQ ID NO: 941 - protein, 42 aa, Artificial Sequence; identical to SEQ ID NO: 308
  Description of Artificial Sequence: Synthetic polypeptide

SEQ ID NO: 942 - protein, 26 aa, Artificial Sequence
  Description of Artificial Sequence: Synthetic peptide
AKYSLSSLDYTAFDPVFFLHHANVDR

SEQ ID NO: 943 - protein, 15 aa, Artificial Sequence
  Description of Artificial Sequence: Synthetic peptide
KKPYNEADCAVNEMR

SEQ ID NO: 944 - protein, 23 aa, Artificial Sequence
  Description of Artificial Sequence: Synthetic peptide
YQYDNLQFNHFSIQKLDQTIQAR

SEQ ID NO: 945 - protein, 12 aa, Artificial Sequence
  Description of Artificial Sequence: Synthetic peptide
LYKFDITSALHK

SEQ ID NO: 946 - protein, 15 aa, Artificial Sequence
  Description of Artificial Sequence: Synthetic peptide
KEVSSLTTLEKHFLR

SEQ ID NO: 947 - protein, 12 aa, Artificial Sequence
  Description of Artificial Sequence: Synthetic peptide
LYTVQFEDSLKR

SEQ ID NO: 948 - protein, 15 aa, Artificial Sequence
  Description of Artificial Sequence: Synthetic peptide
TQEFSKPEDTFDYHR

SEQ ID NO: 949 - protein, 14 aa, Artificial Sequence
  Description of Artificial Sequence: Synthetic peptide
DAVVNNPFAKGYIK

SEQ ID NO: 950 - protein, 5 aa, Artificial Sequence
  Description of Artificial Sequence: Synthetic peptide
KSQTR

SEQ ID NO: 951 - protein, 11 aa, Artificial Sequence
  Description of Artificial Sequence: Synthetic peptide
NFKYDITQALK

SEQ ID NO: 952 - protein, 15 aa, Artificial Sequence
  Description of Artificial Sequence: Synthetic peptide
KDVTSLTASEIENLR

SEQ ID NO: 953 - protein, 10 aa, Artificial Sequence
  Description of Artificial Sequence: Synthetic peptide
QPLKPFSESR

SEQ ID NO: 954 - protein, 5 aa, Artificial Sequence
  Description of Artificial Sequence: Synthetic peptide
KKEER

SEQ ID NO: 955 - protein, 8 aa, Artificial Sequence
  Description of Artificial Sequence: Synthetic peptide
YDITKVLK

SEQ ID NO: 956 - protein, 8 aa, Artificial Sequence
  Description of Artificial Sequence: Synthetic peptide
KKPYNAAK

SEQ ID NO: 957 - protein, 12 aa, Artificial Sequence
  Description of Artificial Sequence: Synthetic peptide
KVQPGHHTRLME

SEQ ID NO: 958 - protein, 12 aa, Artificial Sequence
  Description of Artificial Sequence: Synthetic peptide
LNVYLGERAAKE

SEQ ID NO: 959 - protein, 24 aa, Artificial Sequence
  Description of Artificial Sequence: Synthetic peptide
KPPVPVAQANLAVRKNINDLTAEE

SEQ ID NO: 960 - protein, 16 aa, Artificial Sequence
  Description of Artificial Sequence: Synthetic peptide
RFQNDKSVDGYQATVE

SEQ ID NO: 961 - protein, 17 aa, Artificial Sequence
  Description of Artificial Sequence: Synthetic peptide
HSVPFRVFDYKNNFDYE

SEQ ID NO: 962 - protein, 21 aa, Artificial Sequence
  Description of Artificial Sequence: Synthetic peptide
ITQQLHDLDLHVGDNFFLKYE

SEQ ID NO: 963 - protein, 12 aa, Artificial Sequence
  Description of Artificial Sequence: Synthetic peptide
SIRSAFLQIQKE

SEQ ID NO: 964 - protein, 13 aa, Artificial Sequence
  Description of Artificial Sequence: Synthetic peptide
NIAKFHGKPGLCE

SEQ ID NO: 965 - protein, 13 aa, Artificial Sequence
  Description of Artificial Sequence: Synthetic peptide
NIAKFHGKPGLCE

SEQ ID NO: 966 - protein, 20 aa, Artificial Sequence
  Description of Artificial Sequence: Synthetic peptide
NAVTSRDPQPELWDNKDFYE

SEQ ID NO: 967 - protein, 16 aa, Artificial Sequence
  Description of Artificial Sequence: Synthetic peptide
FSKPEDTFDYHRFGYE

SEQ ID NO: 968 - protein, 18 aa, Artificial Sequence
  Description of Artificial Sequence: Synthetic peptide
FVGMSVSSLHNYIKQQQE

SEQ ID NO: 969 - protein, 20 aa, Artificial Sequence
  Description of Artificial Sequence: Synthetic peptide
LDHAYSLRDGHYYIAGPTKD

SEQ ID NO: 970 - protein, 20 aa, Artificial Sequence
  Description of Artificial Sequence: Synthetic peptide
DLTREHAKPADSFDYGRLGY

SEQ ID NO: 971 - protein, 7 aa, Artificial Sequence
  Description of Artificial Sequence: Synthetic peptide
VGGSEKY

SEQ ID NO: 972 - protein, 6 aa, Artificial Sequence
  Description of Artificial Sequence: Synthetic peptide
QALQKY

SEQ ID NO: 973 - protein, 19 aa, Artificial Sequence
  Description of Artificial Sequence: Synthetic peptide
KYEITQQLHDLDLHVGDNF

SEQ ID NO: 974 - protein, 9 aa, Artificial Sequence
  Description of Artificial Sequence: Synthetic peptide
LQIQKEGIY

SEQ ID NO: 975 - protein, 6 aa, Artificial Sequence
  Description of Artificial Sequence: Synthetic peptide
DNKDFY

SEQ ID NO: 976 - protein, 15 aa, Artificial Sequence
  Description of Artificial Sequence: Synthetic peptide
KHNLPQDSFDYQNRF

SEQ ID NO: 977 - protein, 18 aa, Artificial Sequence
  Description of Artificial Sequence: Synthetic peptide
ICVEQGGEQNCKTKAGSF

SEQ ID NO: 978 - protein, 7 aa, Artificial Sequence
  Description of Artificial Sequence: Synthetic peptide
TTLEKHF

SEQ ID NO: 979 - protein, 9 aa, Artificial Sequence
  Description of Artificial Sequence: Synthetic peptide
SHKTFPNPF

SEQ ID NO: 980 - protein, 11 aa, Artificial Sequence
  Description of Artificial Sequence: Synthetic peptide
IKQQQEADRVF

SEQ ID NO: 981 - protein, 8 aa, Artificial Sequence
  Description of Artificial Sequence: Synthetic peptide
KYDITQAL

SEQ ID NO: 982 - protein, 17 aa, Artificial Sequence
  Description of Artificial Sequence: Synthetic peptide
KAQSIHPEDVFDTDAPF

SEQ ID NO: 983 - protein, 8 aa, Artificial Sequence
  Description of Artificial Sequence: Synthetic peptide
RYDITKVL

SEQ ID NO: 984 - protein, 8 aa, Artificial Sequence
  Description of Artificial Sequence: Synthetic peptide
TSANVKIY

SEQ ID NO: 985 - protein, 8 aa, Artificial Sequence
  Description of Artificial Sequence: Synthetic peptide
IAGPTKDL

SEQ ID NO: 986 - protein, 11 aa, Artificial Sequence
  Description of Artificial Sequence: Synthetic peptide
FEKVQPGHHTR

SEQ ID NO: 987 - protein, 12 aa, Artificial Sequence
  Description of Artificial Sequence: Synthetic peptide
ILDALEQDEFCK

SEQ ID NO: 988 - protein, 14 aa, Artificial Sequence
  Description of Artificial Sequence: Synthetic peptide
LRGKDPNSADCAHN

SEQ ID NO: 989 - protein, 11 aa, Artificial Sequence
  Description of Artificial Sequence: Synthetic peptide
AKPADSFDYGR

SEQ ID NO: 990 - protein, 9 aa, Artificial Sequence
  Description of Artificial Sequence: Synthetic peptide
LLGGPTEMK

SEQ ID NO: 991 - protein, 7 aa, Artificial Sequence
  Description of Artificial Sequence: Synthetic peptide
FDKPPVP

SEQ ID NO: 992 - protein, 8 aa, Artificial Sequence
  Description of Artificial Sequence: Synthetic peptide
VGGSEKYS

SEQ ID NO: 993 - protein, 12 aa, Artificial Sequence
  Description of Artificial Sequence: Synthetic peptide
FHGEPKWCPSPE

SEQ ID NO: 994 - protein, 7 aa, Artificial Sequence
  Description of Artificial Sequence: Synthetic peptide
VFDYKNN

SEQ ID NO: 995 - protein, 6 aa, Artificial Sequence
  Description of Artificial Sequence: Synthetic peptide
LWDNKD

SEQ ID NO: 996 - protein, 15 aa, Artificial Sequence
  Description of Artificial Sequence: Synthetic peptide
LKHNLPQDSFDYQNR

SEQ ID NO: 997 - protein, 17 aa, Artificial Sequence
  Description of Artificial Sequence: Synthetic peptide
ICVEQGGEQNCKTKAGS

SEQ ID NO: 998 - protein, 17 aa, Artificial Sequence
  Description of Artificial Sequence: Synthetic peptide
ICVEQGGEQNCKTKAGS

SEQ ID NO: 999 - protein, 10 aa, Artificial Sequence
  Description of Artificial Sequence: Synthetic peptide
FSHKTFPNPF

SEQ ID NO: 1000 - protein, 12 aa, Artificial Sequence
  Description of Artificial Sequence: Synthetic peptide
FSKPEDTFDYHR

SEQ ID NO: 1001 - protein, 10 aa, Artificial Sequence
  Description of Artificial Sequence: Synthetic peptide
IKQQQEADRV

SEQ ID NO: 1002 - protein, 7 aa, Artificial Sequence
  Description of Artificial Sequence: Synthetic peptide
YWDWTKP

SEQ ID NO: 1003 - protein, 7 aa, Artificial Sequence
  Description of Artificial Sequence: Synthetic peptide
ISKLPDL

SEQ ID NO: 1004 - protein, 5 aa, Artificial Sequence
  Description of Artificial Sequence: Synthetic peptide
FAKGY

SEQ ID NO: 1005 - protein, 5 aa, Artificial Sequence
  Description of Artificial Sequence: Synthetic peptide
FTKMH

SEQ ID NO: 1006 - protein, 10 aa, Artificial Sequence
  Description of Artificial Sequence: Synthetic peptide
LDEANDLKNA

SEQ ID NO: 1007 - protein, 7 aa, Artificial Sequence
  Description of Artificial Sequence: Synthetic peptide
LKEHGSH

SEQ ID NO: 1008 - protein, 7 aa, Artificial Sequence
  Description of Artificial Sequence: Synthetic peptide
IAGPTKD

SEQ ID NO: 1009 - protein, 18 aa, Artificial Sequence
  Description of Artificial Sequence: Synthetic peptide
GFTDPPVKHHQSANLLVR

SEQ ID NO: 1010 - protein, 8 aa, Artificial Sequence
  Description of Artificial Sequence: Synthetic peptide
KNINDLTR

SEQ ID NO: 1011 - protein, 10 aa, Artificial Sequence
  Description of Artificial Sequence: Synthetic peptide
EAFHKFQEDR

SEQ ID NO: 1012 - protein, 18 aa, Artificial Sequence
  Description of Artificial Sequence: Synthetic peptide
TSANVDIFIKTTDSVQHK

SEQ ID NO: 1013 - protein, 19 aa, Artificial Sequence
  Description of Artificial Sequence: Synthetic peptide
TTDSVQHKAGTFAVLGGSK

SEQ ID NO: 1014 - protein, 8 aa, Artificial Sequence
  Description of Artificial Sequence: Synthetic peptide
VKFDKVPR

SEQ ID NO: 1015 - protein, 5 aa, Artificial Sequence
  Description of Artificial Sequence: Synthetic peptide
KNVDR

SEQ ID NO: 1016 - protein, 7 aa, Artificial Sequence
  Description of Artificial Sequence: Synthetic peptide
KALALLK

SEQ ID NO: 1017 - protein, 19 aa, Artificial Sequence
  Description of Artificial Sequence: Synthetic peptide
EDKSAGGFQQLGAFHGEPK

SEQ ID NO: 1018 - protein, 37 aa, Artificial Sequence; identical to SEQ ID NO: 176
  Description of Artificial Sequence: Synthetic polypeptide

SEQ ID NO: 1019 - protein, 18 aa, Artificial Sequence
  Description of Artificial Sequence: Synthetic peptide
HNPWFDGHIDTVDKTTTR

SEQ ID NO: 1020 - protein, 20 aa, Artificial Sequence
  Description of Artificial Sequence: Synthetic peptide
SVQNKLFEQPEFGHYTSIAK

SEQ ID NO: 1021 - protein, 12 aa, Artificial Sequence
  Description of Artificial Sequence: Synthetic peptide
IWAIWQALQKYR

SEQ ID NO: 1022 - protein, 15 aa, Artificial Sequence
  Description of Artificial Sequence: Synthetic peptide
GKPYNVANCAVTSMR

SEQ ID NO: 1023 - protein, 6 aa, Artificial Sequence
  Description of Artificial Sequence: Synthetic peptide
KLEAIK

SEQ ID NO: 1024 - protein, 13 aa, Artificial Sequence
  Description of Artificial Sequence: Synthetic peptide
DLFKQPSVIHEPR

SEQ ID NO: 1025 - protein, 15 aa, Artificial Sequence
  Description of Artificial Sequence: Synthetic peptide
KNIENLSLGELESLR

SEQ ID NO: 1026 - protein, 23 aa, Artificial Sequence
  Description of Artificial Sequence: Synthetic peptide
QHHYETNPFHHGKITHENEITTR

SEQ ID NO: 1027 - protein, 45 aa, Artificial Sequence; identical to SEQ ID NO: 186
  Description of Artificial Sequence: Synthetic polypeptide

SEQ ID NO: 1028 - protein, 5 aa, Artificial Sequence
  Description of Artificial Sequence: Synthetic peptide
KRPYR

SEQ ID NO: 1029 - protein, 9 aa, Artificial Sequence
  Description of Artificial Sequence: Synthetic peptide
KDITQLDKR

SEQ ID NO: 1030 - protein, 17 aa, Artificial Sequence
  Description of Artificial Sequence: Synthetic peptide
KHGAVVGLPYWDWTLPR

SEQ ID NO: 1031 - protein, 10 aa, Artificial Sequence
  Description of Artificial Sequence: Synthetic peptide
NKVMPNPFAR

SEQ ID NO: 1032 - protein, 10 aa, Artificial Sequence
  Description of Artificial Sequence: Synthetic peptide
KHAVPNDVFK

SEQ ID NO: 1033 - protein, 16 aa, Artificial Sequence
  Description of Artificial Sequence: Synthetic peptide
HAVPNDVFKYELLGYR

SEQ ID NO: 1034 - protein, 29 aa, Artificial Sequence
  Description of Artificial Sequence: Synthetic peptide
TSADVQFQICKTSEDCHHGGQIFVLGGTK

SEQ ID NO: 1035 - protein, 19 aa, Artificial Sequence
  Description of Artificial Sequence: Synthetic peptide
KEINTLTTAEVDNLKDAMR

SEQ ID NO: 1036 - protein, 16 aa, Artificial Sequence
  Description of Artificial Sequence: Synthetic peptide
LYTKQMEDALTAHGAR

SEQ ID NO: 1037 - protein, 9 aa, Artificial Sequence
  Description of Artificial Sequence: Synthetic peptide
DKLFNDPER

SEQ ID NO: 1038 - protein, 30 aa, Artificial Sequence; identical to SEQ ID NO: 202
  Description of Artificial Sequence: Synthetic polypeptide

SEQ ID NO: 1039 - protein, 8 aa, Artificial Sequence
  Description of Artificial Sequence: Synthetic peptide
KLEHELEK

SEQ ID NO: 1040 - protein, 6 aa, Artificial Sequence
  Description of Artificial Sequence: Synthetic peptide
QKEEDR

SEQ ID NO: 1041 - protein, 16 aa, Artificial Sequence
  Description of Artificial Sequence: Synthetic peptide
HHEKHHEDHHEDILVR

SEQ ID NO: 1042 - protein, 15 aa, Artificial Sequence
  Description of Artificial Sequence: Synthetic peptide
KNIHSLSHHEAEELR

SEQ ID NO: 1043 - protein, 30 aa, Artificial Sequence; identical to SEQ ID NO: 638
  Description of Artificial Sequence: Synthetic polypeptide

SEQ ID NO: 1044 - protein, 54 aa, Artificial Sequence; identical to SEQ ID NO: 209
  Description of Artificial Sequence: Synthetic polypeptide

SEQ ID NO: 1045 - protein, 33 aa, Artificial Sequence; identical to SEQ ID NO: 13
  Description of Artificial Sequence: Synthetic polypeptide

SEQ ID NO: 1046 - protein, 23 aa, Artificial Sequence
  Description of Artificial Sequence: Synthetic peptide
FNYKYDNLNLHGHNIEELEEVLR

SEQ ID NO: 1047 - protein, 19 aa, Artificial Sequence
  Description of Artificial Sequence: Synthetic peptide
KYDHTELDASVLPAPIIVR

SEQ ID NO: 1048 - protein, 29 aa, Artificial Sequence
  Description of Artificial Sequence: Synthetic peptide
KGFTDPPVKHHQSANLLVRKNINDLTREE

SEQ ID NO: 1049 - protein, 29 aa, Artificial Sequence
  Description of Artificial Sequence: Synthetic peptide
KGFTDPPVKHHQSANLLVRKNINDLTREE

SEQ ID NO: 1050 - protein, 19 aa, Artificial Sequence
  Description of Artificial Sequence: Synthetic peptide
AFHKFQEDRSVDGYQATAE

SEQ ID NO: 1051 - protein, 19 aa, Artificial Sequence
  Description of Artificial Sequence: Synthetic peptide
VDGTKLASSLIPHASVIRE

SEQ ID NO: 1052 - protein, 24 aa, Artificial Sequence
  Description of Artificial Sequence: Synthetic peptide
DKSAGGFQQLGAFHGEPKWCPSPE

SEQ ID NO: 1053 - protein, 17 aa, Artificial Sequence
  Description of Artificial Sequence: Synthetic peptide
HSVPFNVFDYKTNFNYE

SEQ ID NO: 1054 - protein, 31 aa, Artificial Sequence; identical to SEQ ID NO: 224
  Description of Artificial Sequence: Synthetic polypeptide

SEQ ID NO: 1055 - protein, 29 aa, Artificial Sequence
  Description of Artificial Sequence: Synthetic peptide
VFDLKPASLGKDLFKQPSVIHEPRIGHHE

SEQ ID NO: 1056 - protein, 22 aa, Artificial Sequence
  Description of Artificial Sequence: Synthetic peptide
NALLKKGSSVAVPYWDWTKRIE

SEQ ID NO: 1057 - protein, 22 aa, Artificial Sequence
  Description of Artificial Sequence: Synthetic peptide
NALLKKGSSVAVPYWDWTKRIE

SEQ ID NO: 1058 - protein, 22 aa, Artificial Sequence
  Description of Artificial Sequence: Synthetic peptide
NALLKKGSSVAVPYWDWTKRIE

SEQ ID NO: 1059 - protein, 14 aa, Artificial Sequence
  Description of Artificial Sequence: Synthetic peptide
TNPFHHGKITHENE

SEQ ID NO: 1060 - protein, 21 aa, Artificial Sequence
  Description of Artificial Sequence: Synthetic peptide
AGTDSAHTDDGHTEPVMIRKD

SEQ ID NO: 1061 - protein, 17 aa, Artificial Sequence
  Description of Artificial Sequence: Synthetic peptide
ITQLDKRQQLSLVKALE

SEQ ID NO: 1062 - protein, 17 aa, Artificial Sequence
  Description of Artificial Sequence: Synthetic peptide
TGRDIPNPFIGSKIEFE

SEQ ID NO: 1063 - protein, 11 aa, Artificial Sequence
  Description of Artificial Sequence: Synthetic peptide
TLDKMNLRHDE

SEQ ID NO: 1064 - protein, 12 aa, Artificial Sequence
  Description of Artificial Sequence: Synthetic peptide
IGGMNLHEIEKE

SEQ ID NO: 1065 - protein, 15 aa, Artificial Sequence
  Description of Artificial Sequence: Synthetic peptide
AEELRDALYKLQNDE

SEQ ID NO: 1066 - protein, 8 aa, Artificial Sequence
  Description of Artificial Sequence: Synthetic peptide
LGKMYSVE

SEQ ID NO: 1067 - protein, 10 aa, Artificial Sequence
  Description of Artificial Sequence: Synthetic peptide
VLGGPSEMKW

SEQ ID NO: 1068 - protein, 7 aa, Artificial Sequence
  Description of Artificial Sequence: Synthetic peptide
TVKAELF

SEQ ID NO: 1069 - protein, 22 aa, Artificial Sequence
  Description of Artificial Sequence: Synthetic peptide
GGISLENIEKMIHENQQEDRIY

SEQ ID NO: 1070 - protein, 12 aa, Artificial Sequence
  Description of Artificial Sequence: Synthetic peptide
ALLKEDKSAGGF

SEQ ID NO: 1071 - protein, 9 aa, Artificial Sequence
  Description of Artificial Sequence: Synthetic peptide
TSIAKQVLL

SEQ ID NO: 1072 - protein, 6 aa, Artificial Sequence
  Description of Artificial Sequence: Synthetic peptide
QALQKY

SEQ ID NO: 1073 - protein, 9 aa, Artificial Sequence
  Description of Artificial Sequence: Synthetic peptide
NVFDYKTNF

SEQ ID NO: 1074 - protein, 12 aa, Artificial Sequence
  Description of Artificial Sequence: Synthetic peptide
DLKPASLGKDLF

SEQ ID NO: 1075 - protein, 8 aa, Artificial Sequence
  Description of Artificial Sequence: Synthetic peptide
KLDITKAL

SEQ ID NO: 1076 - protein, 7 aa, Artificial Sequence
  Description of Artificial Sequence: Synthetic peptide
VGGKEPY

SEQ ID NO: 1077 - protein, 10 aa, Artificial Sequence
  Description of Artificial Sequence: Synthetic peptide
SERDIGSLKY

SEQ ID NO: 1078 - protein, 7 aa, Artificial Sequence
  Description of Artificial Sequence: Synthetic peptide
KYELLGY

SEQ ID NO: 1079 - protein, 25 aa, Artificial Sequence
  Description of Artificial Sequence: Synthetic peptide
KYDITHALHDAHITPEDVFHPSEPF

SEQ ID NO: 1080 - protein, 13 aa, Artificial Sequence
  Description of Artificial Sequence: Synthetic peptide
THSNAKPTDVFEY

SEQ ID NO: 1081 - protein, 17 aa, Artificial Sequence
  Description of Artificial Sequence: Synthetic peptide
KLQNDESHGGYEHIAGF

SEQ ID NO: 1082 - protein, 12 aa, Artificial Sequence
  Description of Artificial Sequence: Synthetic peptide
ADSGNNNPFFKY

SEQ ID NO: 1083 - protein, 15 aa, Artificial Sequence
  Description of Artificial Sequence: Synthetic peptide
IKSGTDSDDEYAGSF

SEQ ID NO: 1084 - protein, 11 aa, Artificial Sequence
  Description of Artificial Sequence: Synthetic peptide
VILGGAKEMPW

SEQ ID NO: 1085 - protein, 8 aa, Artificial Sequence
  Description of Artificial Sequence: Synthetic peptide
MTPEELKT

SEQ ID NO: 1086 - protein, 19 aa, Artificial Sequence
  Description of Artificial Sequence: Synthetic peptide
VCIPDDNDRNDDHCEKAGD

SEQ ID NO: 1087 - protein, 11 aa, Artificial Sequence
  Description of Artificial Sequence: Synthetic peptide
VLGGPSEMKWQ

SEQ ID NO: 1088 - protein, 7 aa, Artificial Sequence
  Description of Artificial Sequence: Synthetic peptide
LSDTVHK

SEQ ID NO: 1089 - protein, 8 aa, Artificial Sequence
  Description of Artificial Sequence: Synthetic peptide
VVHHPEKG

SEQ ID NO: 1090 - protein, 14 aa, Artificial Sequence
  Description of Artificial Sequence: Synthetic peptide
VIAFEENAPHTKRQ

SEQ ID NO: 1091 - protein, 9 aa, Artificial Sequence
  Description of Artificial Sequence: Synthetic peptide
ISLENIEKM

SEQ ID NO: 1092 - protein, 10 aa, Artificial Sequence
  Description of Artificial Sequence: Synthetic peptide
VDITEVDGTK

SEQ ID NO: 1093 - protein, 7 aa, Artificial Sequence
  Description of Artificial Sequence: Synthetic peptide
LLKEDKS

SEQ ID NO: 1094 - protein, 12 aa, Artificial Sequence
  Description of Artificial Sequence: Synthetic peptide
FHGEPKWCPSPE

SEQ ID NO: 1095 - protein, 7 aa, Artificial Sequence
  Description of Artificial Sequence: Synthetic peptide
LADHEKY

SEQ ID NO: 1096 - protein, 7 aa, Artificial Sequence
  Description of Artificial Sequence: Synthetic peptide
VFDYKTN

SEQ ID NO: 1097 - protein, 6 aa, Artificial Sequence
  Description of Artificial Sequence: Synthetic peptide
LFKQPS

SEQ ID NO: 1098 - protein, 5 aa, Artificial Sequence
  Description of Artificial Sequence: Synthetic peptide
FHHGK

SEQ ID NO: 1099 - protein, 10 aa, Artificial Sequence
  Description of Artificial Sequence: Synthetic peptide
ITTRDPKDSL

SEQ ID NO: 1100 - protein, 9 aa, Artificial Sequence
  Description of Artificial Sequence: Synthetic peptide
LLGGKGKYS

SEQ ID NO: 1101 - protein, 14 aa, Artificial Sequence
  Description of Artificial Sequence: Synthetic peptide
FDKSDNNDEATKTH

SEQ ID NO: 1102 - protein, 8 aa, Artificial Sequence
  Description of Artificial Sequence: Synthetic peptide
VGGKEPYG

SEQ ID NO: 1103 - protein, 12 aa, Artificial Sequence
  Description of Artificial Sequence: Synthetic peptide
FSKPEDTFDYQK

SEQ ID NO: 1104 - protein, 12 aa, Artificial Sequence
  Description of Artificial Sequence: Synthetic peptide
FSKPEDTFDYQK

SEQ ID NO: 1105 - protein, 9 aa, Artificial Sequence
  Description of Artificial Sequence: Synthetic peptide
VLGGEKEMP

SEQ ID NO: 1106 - protein, 7 aa, Artificial Sequence
  Description of Artificial Sequence: Synthetic peptide
YWDWTKP

SEQ ID NO: 1107 - protein, 5 aa, Artificial Sequence
  Description of Artificial Sequence: Synthetic peptide
FTKKH

SEQ ID NO: 1108 - protein, 7 aa, Artificial Sequence
  Description of Artificial Sequence: Synthetic peptide
LHEIEKE

SEQ ID NO: 1109 - protein, 13 aa, Artificial Sequence
  Description of Artificial Sequence: Synthetic peptide
ICKTSEDCHHGGQ

SEQ ID NO: 1110 - protein, 11 aa, Artificial Sequence
  Description of Artificial Sequence: Synthetic peptide
LTTAEVDNLKD

SEQ ID NO: 1111 - protein, 8 aa, Artificial Sequence
  Description of Artificial Sequence: Synthetic peptide
AKPTDVFE

SEQ ID NO: 1112 - protein, 10 aa, Artificial Sequence
  Description of Artificial Sequence: Synthetic peptide
LEKQKEEDRT

SEQ ID NO: 1113 - protein, 12 aa, Artificial Sequence
  Description of Artificial Sequence: Synthetic peptide
IIDTSGKQLPSD

SEQ ID NO: 1114 - protein, 6 aa, Artificial Sequence
  Description of Artificial Sequence: Synthetic peptide
LIKMPT

SEQ ID NO: 1115 - protein, 6 aa, Artificial Sequence
  Description of Artificial Sequence: Synthetic peptide
IFQQTK

SEQ ID NO: 1116 - protein, 9 aa, Artificial Sequence
  Description of Artificial Sequence: Synthetic peptide
LIGGAEKYS

SEQ ID NO: 1117 - protein, 15 aa, Artificial Sequence
  Description of Artificial Sequence: Synthetic peptide
IKSGTDSDDEYAGSF

SEQ ID NO: 1118 - protein, 7 aa, Artificial Sequence
  Description of Artificial Sequence: Synthetic peptide
LTDDHVK

SEQ ID NO: 1119 - protein, 9 aa, Artificial Sequence
  Description of Artificial Sequence: Synthetic peptide
FKCKVPPFS

SEQ ID NO: 1120 - protein, 16 aa, Artificial Sequence
  Description of Artificial Sequence: Synthetic peptide
KNVDSLSSDEVLALEK

SEQ ID NO: 1121 - protein, 9 aa, Artificial Sequence
  Description of Artificial Sequence: Synthetic peptide
ADITFLNKK

SEQ ID NO: 1122 - protein, 12 aa, Artificial Sequence
  Description of Artificial Sequence: Synthetic peptide
LFEKVQPGHHTR

SEQ ID NO: 1123 - protein, 23 aa, Artificial Sequence
  Description of Artificial Sequence: Synthetic peptide
GKDPNSADCAHNLIHTPMEPFDR

SEQ ID NO: 1124 - protein, 13 aa, Artificial Sequence
  Description of Artificial Sequence: Synthetic peptide
EHAKPADSFDYGR

SEQ ID NO: 1125 - protein, 28 aa, Artificial Sequence
  Description of Artificial Sequence: Synthetic peptide
QPTLVHRPAKGHFDKPPVPVAQANLAVR

SEQ ID NO: 1126 - protein, 18 aa, Artificial Sequence
  Description of Artificial Sequence: Synthetic peptide
GHFDKPPVPVAQANLAVR

SEQ ID NO: 1127 - protein, 5 aa, Artificial Sequence
  Description of Artificial Sequence: Synthetic peptide
KAMER

SEQ ID NO: 1128 - protein, 22 aa, Artificial Sequence
  Description of Artificial Sequence: Synthetic peptide
FQNDKSVDGYQATVEFHALPAR

SEQ ID NO: 1129 - protein, 15 aa, Artificial Sequence
  Description of Artificial Sequence: Synthetic peptide
KHGFTGGLPYWDWTR

SEQ ID NO: 1130 - protein, 58 aa, Artificial Sequence; identical to SEQ ID NO: 302
  Description of Artificial Sequence: Synthetic polypeptide

SEQ ID NO: 1131 - protein, 15 aa, Artificial Sequence
  Description of Artificial Sequence: Synthetic peptide
GKPYNTANCAIASMR

SEQ ID NO: 1132 - protein, 19 aa, Artificial Sequence
  Description of Artificial Sequence: Synthetic peptide
KPLQPFGLDSVINPDDETR

SEQ ID NO: 1133 - protein, 27 aa, Artificial Sequence
  Description of Artificial Sequence: Synthetic peptide
VFDYKNNFDYEYESLAFNGLSIAQLDR

SEQ ID NO: 1134 - protein, 31 aa, Artificial Sequence; identical to SEQ ID NO: 25
  Description of Artificial Sequence: Synthetic polypeptide

SEQ ID NO: 1135 - protein, 42 aa, Artificial Sequence; identical to SEQ ID NO: 308
  Description of Artificial Sequence: Synthetic polypeptide

SEQ ID NO: 1136 - protein, 26 aa, Artificial Sequence
  Description of Artificial Sequence: Synthetic peptide
AKYSLSSLDYTAFDPVFFLHHANVDR

SEQ ID NO: 1137 - protein, 15 aa, Artificial Sequence
  Description of Artificial Sequence: Synthetic peptide
KKPYNEADCAVNEMR

SEQ ID NO: 1138 - protein, 15 aa, Artificial Sequence
  Description of Artificial Sequence: Synthetic peptide
KKPYNEADCAVNEMR

SEQ ID NO: 1139 - protein, 19 aa, Artificial Sequence
  Description of Artificial Sequence: Synthetic peptide
KPLQPFNNPELNSDSMTLK

SEQ ID NO: 1140 - protein, 32 aa, Artificial Sequence; identical to SEQ ID NO: 27
  Description of Artificial Sequence: Synthetic polypeptide

SEQ ID NO: 1141 - protein, 23 aa, Artificial Sequence
  Description of Artificial Sequence: Synthetic peptide
YQYDNLQFNHFSIQKLDQTIQAR

SEQ ID NO: 1142 - protein, 15 aa, Artificial Sequence
  Description of Artificial Sequence: Synthetic peptide
KEVSSLTTLEKHFLR

SEQ ID NO: 1143 - protein, 12 aa, Artificial Sequence
  Description of Artificial Sequence: Synthetic peptide
LYTVQFEDSLKR

SEQ ID NO: 1144 - protein, 15 aa, Artificial Sequence
  Description of Artificial Sequence: Synthetic peptide
TQEFSKPEDTFDYHR

SEQ ID NO: 1145 - protein, 8 aa, Artificial Sequence
  Description of Artificial Sequence: Synthetic peptide
YDITKTLK

SEQ ID NO: 1146 - protein, 10 aa, Artificial Sequence
  Description of Artificial Sequence: Synthetic peptide
DLASLKSAMR

SEQ ID NO: 1147 - protein, 14 aa, Artificial Sequence
  Description of Artificial Sequence: Synthetic peptide
DAVVNNPFAKGYIK

SEQ ID NO: 1148 - protein, 12 aa, Artificial Sequence
  Description of Artificial Sequence: Synthetic peptide
GYIKSEDAYTVR

SEQ ID NO: 1149 - protein, 15 aa, Artificial Sequence
  Description of Artificial Sequence: Synthetic peptide
KDVTSLTASEIENLR

SEQ ID NO: 1150 - protein, 12 aa, Artificial Sequence
  Description of Artificial Sequence: Synthetic peptide
IWAIWQALQKYR

SEQ ID NO: 1151 - protein, 10 aa, Artificial Sequence
  Description of Artificial Sequence: Synthetic peptide
QPLKPFSESR

SEQ ID NO: 1152 - protein, 8 aa, Artificial Sequence
  Description of Artificial Sequence: Synthetic peptide
YDITKVLK

SEQ ID NO: 1153 - protein, 8 aa, Artificial Sequence
  Description of Artificial Sequence: Synthetic peptide
KKPYNAAK

SEQ ID NO: 1154 - protein, 12 aa, Artificial Sequence
  Description of Artificial Sequence: Synthetic peptide
KVQPGHHTRLME

SEQ ID NO: 1155 - protein, 24 aa, Artificial Sequence
  Description of Artificial Sequence: Synthetic peptide
KPPVPVAQANLAVRKNINDLTAEE

SEQ ID NO: 1156 - protein, 16 aa, Artificial Sequence
  Description of Artificial Sequence: Synthetic peptide
RFQNDKSVDGYQATVE

SEQ ID NO: 1157 - protein, 21 aa, Artificial Sequence
  Description of Artificial Sequence: Synthetic peptide
ITQQLHDLDLHVGDNFFLKYE

SEQ ID NO: 1158 - protein, 12 aa, Artificial Sequence
  Description of Artificial Sequence: Synthetic peptide
SIRSAFLQIQKE

SEQ ID NO: 1159 - protein, 13 aa, Artificial Sequence
  Description of Artificial Sequence: Synthetic peptide
NIAKFHGKPGLCE

SEQ ID NO: 1160 - protein, 13 aa, Artificial Sequence
  Description of Artificial Sequence: Synthetic peptide
NIAKFHGKPGLCE

SEQ ID NO: 1161 - protein, 25 aa, Artificial Sequence
  Description of Artificial Sequence: Synthetic peptide
RGSAVAVPYWDWTEKADSLPSLIND

SEQ ID NO: 1162 - protein, 20 aa, Artificial Sequence
  Description of Artificial Sequence: Synthetic peptide
NAVTSRDPQPELWDNKDFYE

SEQ ID NO: 1163 - protein, 16 aa, Artificial Sequence
  Description of Artificial Sequence: Synthetic peptide
FSKPEDTFDYHRFGYE

SEQ ID NO: 1164 - protein, 18 aa, Artificial Sequence
  Description of Artificial Sequence: Synthetic peptide
FVGMSVSSLHNYIKQQQE

SEQ ID NO: 1165 - protein, 8 aa, Artificial Sequence
  Description of Artificial Sequence: Synthetic peptide
APFFIKVE

SEQ ID NO: 1166 - protein, 20 aa, Artificial Sequence
  Description of Artificial Sequence: Synthetic peptide
LDHAYSLRDGHYYIAGPTKD

SEQ ID NO: 1167 - protein, 14 aa, Artificial Sequence
  Description of Artificial Sequence: Synthetic peptide
LNKKTSRAVDDRLF

SEQ ID NO: 1168 - protein, 11 aa, Artificial Sequence
  Description of Artificial Sequence: Synthetic peptide
EKVQPGHHTRL

SEQ ID NO: 1169 - protein, 20 aa, Artificial Sequence
  Description of Artificial Sequence: Synthetic peptide
DLTREHAKPADSFDYGRLGY

SEQ ID NO: 1170 - protein, 10 aa, Artificial Sequence
  Description of Artificial Sequence: Synthetic peptide
LLGGPTEMKW

SEQ ID NO: 1171 - protein, 21 aa, Artificial Sequence
  Description of Artificial Sequence: Synthetic peptide
VHRPAKGHFDKPPVPVAQANL

SEQ ID NO: 1172 - protein, 7 aa, Artificial Sequence
  Description of Artificial Sequence: Synthetic peptide
VGGSEKY

SEQ ID NO: 1173 - protein, 9 aa, Artificial Sequence
  Description of Artificial Sequence: Synthetic peptide
TDIAKQVLL

SEQ ID NO: 1174 - protein, 6 aa, Artificial Sequence
  Description of Artificial Sequence: Synthetic peptide
QALQKY

SEQ ID NO: 1175 - protein, 9 aa, Artificial Sequence
  Description of Artificial Sequence: Synthetic peptide
LQIQKEGIY

SEQ ID NO: 1176 - protein, 15 aa, Artificial Sequence
  Description of Artificial Sequence: Synthetic peptide
KHNLPQDSFDYQNRF

SEQ ID NO: 1177 - protein, 18 aa, Artificial Sequence
  Description of Artificial Sequence: Synthetic peptide
ICVEQGGEQNCKTKAGSF

SEQ ID NO: 1178 - protein, 7 aa, Artificial Sequence
  Description of Artificial Sequence: Synthetic peptide
TTLEKHF

SEQ ID NO: 1179 - protein, 12 aa, Artificial Sequence
  Description of Artificial Sequence: Synthetic peptide
KNMQADDSPDGY

SEQ ID NO: 1180 - protein, 9 aa, Artificial Sequence
  Description of Artificial Sequence: Synthetic peptide
SHKTFPNPF

SEQ ID NO: 1181 - protein, 11 aa, Artificial Sequence
  Description of Artificial Sequence: Synthetic peptide
IKQQQEADRVF

SEQ ID NO: 1182 - protein, 5 aa, Artificial Sequence
  Description of Artificial Sequence: Synthetic peptide
LLKGF

SEQ ID NO: 1183 - protein, 8 aa, Artificial Sequence
  Description of Artificial Sequence: Synthetic peptide
KYDITQAL

SEQ ID NO: 1184 - protein, 17 aa, Artificial Sequence
  Description of Artificial Sequence: Synthetic peptide
KAQSIHPEDVFDTDAPF

SEQ ID NO: 1185 - protein, 7 aa, Artificial Sequence
  Description of Artificial Sequence: Synthetic peptide
KQPLKPF

SEQ ID NO: 1186 - protein, 7 aa, Artificial Sequence
  Description of Artificial Sequence: Synthetic peptide
KQPLKPF

SEQ ID NO: 1187 - protein, 8 aa, Artificial Sequence
  Description of Artificial Sequence: Synthetic peptide
TSANVKIY

SEQ ID NO: 1188 - protein, 11 aa, Artificial Sequence
  Description of Artificial Sequence: Synthetic peptide
FEKVQPGHHTR

SEQ ID NO: 1189 - protein, 8 aa, Artificial Sequence
  Description of Artificial Sequence: Synthetic peptide
LEQDEFCK

SEQ ID NO: 1190 - protein, 14 aa, Artificial Sequence
  Description of Artificial Sequence: Synthetic peptide
LRGKDPNSADCAHN

SEQ ID NO: 1191 - protein, 11 aa, Artificial Sequence
  Description of Artificial Sequence: Synthetic peptide
AKPADSFDYGR

SEQ ID NO: 1192 - protein, 10 aa, Artificial Sequence
  Description of Artificial Sequence: Synthetic peptide
LGGPTEMKWG

SEQ ID NO: 1193 - protein, 6 aa, Artificial Sequence
  Description of Artificial Sequence: Synthetic peptide
FQNDKS

SEQ ID NO: 1194 - protein, 12 aa, Artificial Sequence
  Description of Artificial Sequence: Synthetic peptide
LDPVTGETKNNP

SEQ ID NO: 1195 - protein, 8 aa, Artificial Sequence
  Description of Artificial Sequence: Synthetic peptide
VGGSEKYS

SEQ ID NO: 1196 - protein, 12 aa, Artificial Sequence
  Description of Artificial Sequence: Synthetic peptide
FHGEPKWCPSPE

SEQ ID NO: 1197 - protein, 9 aa, Artificial Sequence
  Description of Artificial Sequence: Synthetic peptide
IQKEGIYEN

SEQ ID NO: 1198 - protein, 6 aa, Artificial Sequence
  Description of Artificial Sequence: Synthetic peptide
LWDNKD

SEQ ID NO: 1199 - protein, 15 aa, Artificial Sequence
  Description of Artificial Sequence: Synthetic peptide
LKHNLPQDSFDYQNR

SEQ ID NO: 1200 - protein, 17 aa, Artificial Sequence
  Description of Artificial Sequence: Synthetic peptide
ICVEQGGEQNCKTKAGS

SEQ ID NO: 1201 - protein, 17 aa, Artificial Sequence
  Description of Artificial Sequence: Synthetic peptide
ICVEQGGEQNCKTKAGS

SEQ ID NO: 1202 - protein, 10 aa, Artificial Sequence
  Description of Artificial Sequence: Synthetic peptide
FSHKTFPNPF

SEQ ID NO: 1203 - protein, 12 aa, Artificial Sequence
  Description of Artificial Sequence: Synthetic peptide
FSKPEDTFDYHR

SEQ ID NO: 1204 - protein, 10 aa, Artificial Sequence
  Description of Artificial Sequence: Synthetic peptide
IKQQQEADRV

SEQ ID NO: 1205 - protein, 7 aa, Artificial Sequence
  Description of Artificial Sequence: Synthetic peptide
YWDWTKP

SEQ ID NO: 1206 - protein, 7 aa, Artificial Sequence
  Description of Artificial Sequence: Synthetic peptide
ISKLPDL

SEQ ID NO: 1207 - protein, 5 aa, Artificial Sequence
  Description of Artificial Sequence: Synthetic peptide
FAKGY

SEQ ID NO: 1208 - protein, 8 aa, Artificial Sequence
  Description of Artificial Sequence: Synthetic peptide
IKSEDAYT

SEQ ID NO: 1209 - protein, 12 aa, Artificial Sequence
  Description of Artificial Sequence: Synthetic peptide
AMLQERKKEERT

SEQ ID NO: 1210 - protein, 10 aa, Artificial Sequence
  Description of Artificial Sequence: Synthetic peptide
LDEANDLKNA

SEQ ID NO: 1211 - protein, 7 aa, Artificial Sequence
  Description of Artificial Sequence: Synthetic peptide
LKEHGSH

SEQ ID NO: 1212 - protein, 7 aa, Artificial Sequence
  Description of Artificial Sequence: Synthetic peptide
IAGPTKD

SEQ ID NO: 1213 - protein, 18 aa, Artificial Sequence
  Description of Artificial Sequence: Synthetic peptide
GFTDPPVKHHQSANLLVR

SEQ ID NO: 1214 - protein, 8 aa, Artificial Sequence
  Description of Artificial Sequence: Synthetic peptide
KNINDLTR

SEQ ID NO: 1215 - protein, 10 aa, Artificial Sequence
  Description of Artificial Sequence: Synthetic peptide
EAFHKFQEDR

SEQ ID NO: 1216 - protein, 9 aa, Artificial Sequence
  Description of Artificial Sequence: Synthetic peptide
CPRPDAKDR

SEQ ID NO: 1217 - protein, 8 aa, Artificial Sequence
  Description of Artificial Sequence: Synthetic peptide
VKFDKVPR

SEQ ID NO: 1218 - protein, 5 aa, Artificial Sequence
  Description of Artificial Sequence: Synthetic peptide
KNVDR

SEQ ID NO: 1219 - protein, 7 aa, Artificial Sequence
  Description of Artificial Sequence: Synthetic peptide
KALALLK

SEQ ID NO: 1220 - protein, 19 aa, Artificial Sequence
  Description of Artificial Sequence: Synthetic peptide
EDKSAGGFQQLGAFHGEPK

SEQ ID NO: 1221 - protein, 37 aa, Artificial Sequence; identical to SEQ ID NO: 176
  Description of Artificial Sequence: Synthetic polypeptide

SEQ ID NO: 1222 - protein, 18 aa, Artificial Sequence
  Description of Artificial Sequence: Synthetic peptide
HNPWFDGHIDTVDKTTTR

SEQ ID NO: 1223 - protein, 20 aa, Artificial Sequence
  Description of Artificial Sequence: Synthetic peptide
SVQNKLFEQPEFGHYTSIAK

SEQ ID NO: 1224 - protein, 12 aa, Artificial Sequence
  Description of Artificial Sequence: Synthetic peptide
IWAIWQALQKYR

SEQ ID NO: 1225 - protein, 15 aa, Artificial Sequence
  Description of Artificial Sequence: Synthetic peptide
GKPYNVANCAVTSMR

SEQ ID NO: 1226 - protein, 6 aa, Artificial Sequence
  Description of Artificial Sequence: Synthetic peptide
KLEAIK

SEQ ID NO: 1227 - protein, 9 aa, Artificial Sequence
  Description of Artificial Sequence: Synthetic peptide
VFKYDITEK

SEQ ID NO: 1228 - protein, 13 aa, Artificial Sequence
  Description of Artificial Sequence: Synthetic peptide
DLFKQPSVIHEPR

SEQ ID NO: 1229 - protein, 15 aa, Artificial Sequence
  Description of Artificial Sequence: Synthetic peptide
KNIENLSLGELESLR

SEQ ID NO: 1230 - protein, 23 aa, Artificial Sequence
  Description of Artificial Sequence: Synthetic peptide
QHHYETNPFHHGKITHENEITTR

SEQ ID NO: 1231 - protein, 45 aa, Artificial Sequence; identical to SEQ ID NO: 186
  Description of Artificial Sequence: Synthetic polypeptide

SEQ ID NO: 1232 - protein, 5 aa, Artificial Sequence
  Description of Artificial Sequence: Synthetic peptide
KRPYR

SEQ ID NO: 1233 - protein, 9 aa, Artificial Sequence
  Description of Artificial Sequence: Synthetic peptide
KDITQLDKR

SEQ ID NO: 1234 - protein, 9 aa, Artificial Sequence
  Description of Artificial Sequence: Synthetic peptide
KDITQLDKR

SEQ ID NO: 1235 - protein, 29 aa, Artificial Sequence
  Description of Artificial Sequence: Synthetic peptide
ADHSSDGFQAIASFHALPPLCPSPAASKR

SEQ ID NO: 1236 - protein, 17 aa, Artificial Sequence
  Description of Artificial Sequence: Synthetic peptide
KHGAVVGLPYWDWTLPR

SEQ ID NO: 1237 - protein, 12 aa, Artificial Sequence
  Description of Artificial Sequence: Synthetic peptide
LYKYDITETLDK

SEQ ID NO: 1238 - protein, 10 aa, Artificial Sequence
  Description of Artificial Sequence: Synthetic peptide
NKVMPNPFAR

SEQ ID NO: 1239 - protein, 10 aa, Artificial Sequence
  Description of Artificial Sequence: Synthetic peptide
EIKDKQHHVR

SEQ ID NO: 1240 - protein, 29 aa, Artificial Sequence
  Description of Artificial Sequence: Synthetic peptide
TSADVQFQICKTSEDCHHGGQIFVLGGTK

SEQ ID NO: 1241 - protein, 16 aa, Artificial Sequence
  Description of Artificial Sequence: Synthetic peptide
LYTKQMEDALTAHGAR

SEQ ID NO: 1242 - protein, 9 aa, Artificial Sequence
  Description of Artificial Sequence: Synthetic peptide
DKLFNDPER

SEQ ID NO: 1243 - protein, 8 aa, Artificial Sequence
  Description of Artificial Sequence: Synthetic peptide
KLEHELEK

SEQ ID NO: 1244 - protein, 6 aa, Artificial Sequence
  Description of Artificial Sequence: Synthetic peptide
QKEEDR

SEQ ID NO: 1245 - protein, 15 aa, Artificial Sequence
  Description of Artificial Sequence: Synthetic peptide
IIDTSGKQLPSDLIK

SEQ ID NO: 1246 - protein, 16 aa, Artificial Sequence
  Description of Artificial Sequence: Synthetic peptide
HHEKHHEDHHEDILVR

SEQ ID NO: 1247 - protein, 15 aa, Artificial Sequence
  Description of Artificial Sequence: Synthetic peptide
KNIHSLSHHEAEELR

SEQ ID NO: 1248 - protein, 54 aa, Artificial Sequence; identical to SEQ ID NO: 209
  Description of Artificial Sequence: Synthetic polypeptide

SEQ ID NO: 1249 - protein, 33 aa, Artificial Sequence; identical to SEQ ID NO: 13
  Description of Artificial Sequence: Synthetic polypeptide

SEQ ID NO: 1250 - protein, 23 aa, Artificial Sequence
  Description of Artificial Sequence: Synthetic peptide
FNYKYDNLNLHGHNIEELEEVLR

SEQ ID NO: 1251 - protein, 10 aa, Artificial Sequence
  Description of Artificial Sequence: Synthetic peptide
TTAVVKVYIK

SEQ ID NO: 1252 - protein, 19 aa, Artificial Sequence
  Description of Artificial Sequence: Synthetic peptide
KYDHTELDASVLPAPIIVR

SEQ ID NO: 1253 - protein, 29 aa, Artificial Sequence
  Description of Artificial Sequence: Synthetic peptide
KGFTDPPVKHHQSANLLVRKNINDLTREE

SEQ ID NO: 1254 - protein, 29 aa, Artificial Sequence
  Description of Artificial Sequence: Synthetic peptide
KGFTDPPVKHHQSANLLVRKNINDLTREE

SEQ ID NO: 1255 - protein, 29 aa, Artificial Sequence
  Description of Artificial Sequence: Synthetic peptide
KGFTDPPVKHHQSANLLVRKNINDLTREE

SEQ ID NO: 1256 - protein, 19 aa, Artificial Sequence
  Description of Artificial Sequence: Synthetic peptide
AFHKFQEDRSVDGYQATAE

SEQ ID NO: 1257 - protein, 8 aa, Artificial Sequence
  Description of Artificial Sequence: Synthetic peptide
NIEKMIHE

SEQ ID NO: 1258 - protein, 19 aa, Artificial Sequence
  Description of Artificial Sequence: Synthetic peptide
VDGTKLASSLIPHASVIRE

SEQ ID NO: 1259 - protein, 24 aa, Artificial Sequence
  Description of Artificial Sequence: Synthetic peptide
DKSAGGFQQLGAFHGEPKWCPSPE

SEQ ID NO: 1260 - protein, 17 aa, Artificial Sequence
  Description of Artificial Sequence: Synthetic peptide
HSVPFNVFDYKTNFNYE

SEQ ID NO: 1261 - protein, 14 aa, Artificial Sequence
  Description of Artificial Sequence: Synthetic peptide
FNGLSISQLNKKLE

SEQ ID NO: 1262 - protein, 22 aa, Artificial Sequence
  Description of Artificial Sequence: Synthetic peptide
NALLKKGSSVAVPYWDWTKRIE

SEQ ID NO: 1263 - protein, 22 aa, Artificial Sequence
  Description of Artificial Sequence: Synthetic peptide
NALLKKGSSVAVPYWDWTKRIE

SEQ ID NO: 1264 - protein, 14 aa, Artificial Sequence
  Description of Artificial Sequence: Synthetic peptide
TNPFHHGKITHENE

SEQ ID NO: 1265 - protein, 21 aa, Artificial Sequence
  Description of Artificial Sequence: Synthetic peptide
AGTDSAHTDDGHTEPVMIRKD

SEQ ID NO: 1266 - protein, 17 aa, Artificial Sequence
  Description of Artificial Sequence: Synthetic peptide
ITQLDKRQQLSLVKALE

SEQ ID NO: 1267 - protein, 17 aa, Artificial Sequence
  Description of Artificial Sequence: Synthetic peptide
ITQLDKRQQLSLVKALE

SEQ ID NO: 1268 - protein, 28 aa, Artificial Sequence
  Description of Artificial Sequence: Synthetic peptide
LLTVSTIHDPETGRDIPNPFIGSKIEFE

SEQ ID NO: 1269 - protein, 11 aa, Artificial Sequence
  Description of Artificial Sequence: Synthetic peptide
TLDKMNLRHDE

SEQ ID NO: 1270 - protein, 12 aa, Artificial Sequence
  Description of Artificial Sequence: Synthetic peptide
IGGMNLHEIEKE

SEQ ID NO: 1271 - protein, 15 aa, Artificial Sequence
  Description of Artificial Sequence: Synthetic peptide
AEELRDALYKLQNDE

SEQ ID NO: 1272 - protein, 8 aa, Artificial Sequence
  Description of Artificial Sequence: Synthetic peptide
LGKMYSVE

SEQ ID NO: 1273 - protein, 10 aa, Artificial Sequence
  Description of Artificial Sequence: Synthetic peptide
VLGGPSEMKW

SEQ ID NO: 1274 - protein, 7 aa, Artificial Sequence
  Description of Artificial Sequence: Synthetic peptide
TVKAELF

SEQ ID NO: 1275 - protein, 12 aa, Artificial Sequence
  Description of Artificial Sequence: Synthetic peptide
HKFQEDRSVDGY

SEQ ID NO: 1276 - protein, 9 aa, Artificial Sequence
  Description of Artificial Sequence: Synthetic peptide
KEDKSAGGF

SEQ ID NO: 1277 - protein, 9 aa, Artificial Sequence
  Description of Artificial Sequence: Synthetic peptide
TSIAKQVLL

SEQ ID NO: 1278 - protein, 6 aa, Artificial Sequence
  Description of Artificial Sequence: Synthetic peptide
QALQKY

SEQ ID NO: 1279 - protein, 11 aa, Artificial Sequence
  Description of Artificial Sequence: Synthetic peptide
KYDITEKLHDL

SEQ ID NO: 1280 - protein, 8 aa, Artificial Sequence
  Description of Artificial Sequence: Synthetic peptide
KLDITKAL

SEQ ID NO: 1281 - protein, 16 aa, Artificial Sequence
  Description of Artificial Sequence: Synthetic peptide
HALPPLCPSPAASKRF

SEQ ID NO: 1282 - protein, 7 aa, Artificial Sequence
  Description of Artificial Sequence: Synthetic peptide
VGGKEPY

SEQ ID NO: 1283 - protein, 16 aa, Artificial Sequence
  Description of Artificial Sequence: Synthetic peptide
NLNDHTHDFSKPEDTF

SEQ ID NO: 1284 - protein, 10 aa, Artificial Sequence
  Description of Artificial Sequence: Synthetic peptide
SERDIGSLKY

SEQ ID NO: 1285 - protein, 13 aa, Artificial Sequence
  Description of Artificial Sequence: Synthetic peptide
THSNAKPTDVFEY

SEQ ID NO: 1286 - protein, 11 aa, Artificial Sequence
  Description of Artificial Sequence: Synthetic peptide
KLQNDESHGGY

SEQ ID NO: 1287 - protein, 12 aa, Artificial Sequence
  Description of Artificial Sequence: Synthetic peptide
ADSGNNNPFFKY

SEQ ID NO: 1288 - protein, 15 aa, Artificial Sequence
  Description of Artificial Sequence: Synthetic peptide
IKSGTDSDDEYAGSF

SEQ ID NO: 1289 - protein, 11 aa, Artificial Sequence
  Description of Artificial Sequence: Synthetic peptide
VILGGAKEMPW

SEQ ID NO: 1290 - protein, 9 aa, Artificial Sequence
  Description of Artificial Sequence: Synthetic peptide
MTPEELKTY

SEQ ID NO: 1291 - protein, 19 aa, Artificial Sequence
  Description of Artificial Sequence: Synthetic peptide
VCIPDDNDRNDDHCEKAGD

SEQ ID NO: 1292 - protein, 11 aa, Artificial Sequence
  Description of Artificial Sequence: Synthetic peptide
VLGGPSEMKWQ

SEQ ID NO: 1293 - protein, 7 aa, Artificial Sequence
  Description of Artificial Sequence: Synthetic peptide
LSDTVHK

SEQ ID NO: 1294 - protein, 7 aa, Artificial Sequence
  Description of Artificial Sequence: Synthetic peptide
VHHPEKG

SEQ ID NO: 1295 - protein, 9 aa, Artificial Sequence
  Description of Artificial Sequence: Synthetic peptide
ISLENIEKM

SEQ ID NO: 1296 - protein, 11 aa, Artificial Sequence
  Description of Artificial Sequence: Synthetic peptide
VDITEVDGTKL

SEQ ID NO: 1297 - protein, 7 aa, Artificial Sequence
  Description of Artificial Sequence: Synthetic peptide
LLKEDKS

SEQ ID NO: 1298 - protein, 12 aa, Artificial Sequence
  Description of Artificial Sequence: Synthetic peptide
FHGEPKWCPSPE

SEQ ID NO: 1299 - protein, 7 aa, Artificial Sequence
  Description of Artificial Sequence: Synthetic peptide
LADHEKY

SEQ ID NO: 1300 - protein, 13 aa, Artificial Sequence
  Description of Artificial Sequence: Synthetic peptide
VDPEDGVEKHNPW

SEQ ID NO: 1301 - protein, 7 aa, Artificial Sequence
  Description of Artificial Sequence: Synthetic peptide
VFDYKTN

SEQ ID NO: 1302 - protein, 9 aa, Artificial Sequence
  Description of Artificial Sequence: Synthetic peptide
LLGGKGKYS

SEQ ID NO: 1303 - protein, 14 aa, Artificial Sequence
  Description of Artificial Sequence: Synthetic peptide
FDKSDNNDEATKTH

SEQ ID NO: 1304 - protein, 14 aa, Artificial Sequence
  Description of Artificial Sequence: Synthetic peptide
FDKSDNNDEATKTH

SEQ ID NO: 1305 - protein, 8 aa, Artificial Sequence
  Description of Artificial Sequence: Synthetic peptide
VGGKEPYG

SEQ ID NO: 1306 - protein, 12 aa, Artificial Sequence
  Description of Artificial Sequence: Synthetic peptide
FSKPEDTFDYQK

SEQ ID NO: 1307 - protein, 12 aa, Artificial Sequence
  Description of Artificial Sequence: Synthetic peptide
FSKPEDTFDYQK

SEQ ID NO: 1308 - protein, 9 aa, Artificial Sequence
  Description of Artificial Sequence: Synthetic peptide
VLGGEKEMP

SEQ ID NO: 1309 - protein, 11 aa, Artificial Sequence
  Description of Artificial Sequence: Synthetic peptide
VAVPYWDWTKP

SEQ ID NO: 1310 - protein, 5 aa, Artificial Sequence
  Description of Artificial Sequence: Synthetic peptide
FTKKH

SEQ ID NO: 1311 - protein, 7 aa, Artificial Sequence
  Description of Artificial Sequence: Synthetic peptide
LHEIEKE

SEQ ID NO: 1312 - protein, 13 aa, Artificial Sequence
  Description of Artificial Sequence: Synthetic peptide
ICKTSEDCHHGGQ

SEQ ID NO: 1313 - protein, 12 aa, Artificial Sequence
  Description of Artificial Sequence: Synthetic peptide
LTTAEVDNLKDA

SEQ ID NO: 1314 - protein, 10 aa, Artificial Sequence
  Description of Artificial Sequence: Synthetic peptide
LEKQKEEDRT

SEQ ID NO: 1315 - protein, 12 aa, Artificial Sequence
  Description of Artificial Sequence: Synthetic peptide
IIDTSGKQLPSD

SEQ ID NO: 1316 - protein, 6 aa, Artificial Sequence
  Description of Artificial Sequence: Synthetic peptide
LIKMPT

SEQ ID NO: 1317 - protein, 6 aa, Artificial Sequence
  Description of Artificial Sequence: Synthetic peptide
IFQQTK

SEQ ID NO: 1318 - protein, 9 aa, Artificial Sequence
  Description of Artificial Sequence: Synthetic peptide
LIGGAEKYS

SEQ ID NO: 1319 - protein, 15 aa, Artificial Sequence
  Description of Artificial Sequence: Synthetic peptide
IKSGTDSDDEYAGSF

SEQ ID NO: 1320 - protein, 7 aa, Artificial Sequence
  Description of Artificial Sequence: Synthetic peptide
LTDDHVK

SEQ ID NO: 1321 - protein, 16 aa, Artificial Sequence
  Description of Artificial Sequence: Synthetic peptide
KNVDSLSSDEVLALEK

SEQ ID NO: 1322 - protein, 9 aa, Artificial Sequence
  Description of Artificial Sequence: Synthetic peptide
ADITFLNKK

SEQ ID NO: 1323 - protein, 12 aa, Artificial Sequence
  Description of Artificial Sequence: Synthetic peptide
LFEKVQPGHHTR

SEQ ID NO: 1324 - protein, 23 aa, Artificial Sequence
  Description of Artificial Sequence: Synthetic peptide
GKDPNSADCAHNLIHTPMEPFDR

SEQ ID NO: 1325 - protein, 13 aa, Artificial Sequence
  Description of Artificial Sequence: Synthetic peptide
EHAKPADSFDYGR

SEQ ID NO: 1326 - protein, 19 aa, Artificial Sequence
  Description of Artificial Sequence: Synthetic peptide
AGDFFLLGGPTEMKWGFYR

SEQ ID NO: 1327 - protein, 18 aa, Artificial Sequence
  Description of Artificial Sequence: Synthetic peptide
GHFDKPPVPVAQANLAVR

SEQ ID NO: 1328 - protein, 22 aa, Artificial Sequence
  Description of Artificial Sequence: Synthetic peptide
FQNDKSVDGYQATVEFHALPAR

SEQ ID NO: 1329 - protein, 9 aa, Artificial Sequence
  Description of Artificial Sequence: Synthetic peptide
CPRPDAKDR

SEQ ID NO: 1330 - protein, 15 aa, Artificial Sequence
  Description of Artificial Sequence: Synthetic peptide
KHGFTGGLPYWDWTR

SEQ ID NO: 1331 - protein, 15 aa, Artificial Sequence
  Description of Artificial Sequence: Synthetic peptide
GKPYNTANCAIASMR

SEQ ID NO: 1332 - protein, 19 aa, Artificial Sequence
  Description of Artificial Sequence: Synthetic peptide
KPLQPFGLDSVINPDDETR

SEQ ID NO: 1333 - protein, 27 aa, Artificial Sequence
  Description of Artificial Sequence: Synthetic peptide
VFDYKNNFDYEYESLAFNGLSIAQLDR

SEQ ID NO: 1334 - protein, 31 aa, Artificial Sequence; identical to SEQ ID NO: 25
  Description of Artificial Sequence: Synthetic polypeptide

SEQ ID NO: 1335 - protein, 42 aa, Artificial Sequence; identical to SEQ ID NO: 308
  Description of Artificial Sequence: Synthetic polypeptide

SEQ ID NO: 1336 - protein, 26 aa, Artificial Sequence
  Description of Artificial Sequence: Synthetic peptide
AKYSLSSLDYTAFDPVFFLHHANVDR

SEQ ID NO: 1337 - protein, 15 aa, Artificial Sequence
  Description of Artificial Sequence: Synthetic peptide
KKPYNEADCAVNEMR

SEQ ID NO: 1338 - protein, 23 aa, Artificial Sequence
  Description of Artificial Sequence: Synthetic peptide
YQYDNLQFNHFSIQKLDQTIQAR

SEQ ID NO: 1339 - protein, 15 aa, Artificial Sequence
  Description of Artificial Sequence: Synthetic peptide
KEVSSLTTLEKHFLR

SEQ ID NO: 1340 - protein, 12 aa, Artificial Sequence
  Description of Artificial Sequence: Synthetic peptide
LYTVQFEDSLKR

SEQ ID NO: 1341 - protein, 22 aa, Artificial Sequence
  Description of Artificial Sequence: Synthetic peptide
TFPNPFLKANIEFEGEGVTTER

SEQ ID NO: 1342 - protein, 15 aa, Artificial Sequence
  Description of Artificial Sequence: Synthetic peptide
TQEFSKPEDTFDYHR

SEQ ID NO: 1343 - protein, 8 aa, Artificial Sequence
  Description of Artificial Sequence: Synthetic peptide
YDITKTLK

SEQ ID NO: 1344 - protein, 12 aa, Artificial Sequence
  Description of Artificial Sequence: Synthetic peptide
GYIKSEDAYTVR

SEQ ID NO: 1345 - protein, 11 aa, Artificial Sequence
  Description of Artificial Sequence: Synthetic peptide
NFKYDITQALK

SEQ ID NO: 1346 - protein, 15 aa, Artificial Sequence
  Description of Artificial Sequence: Synthetic peptide
KDVTSLTASEIENLR

SEQ ID NO: 1347 - protein, 12 aa, Artificial Sequence
  Description of Artificial Sequence: Synthetic peptide
IWAIWQALQKYR

SEQ ID NO: 1348 - protein, 10 aa, Artificial Sequence
  Description of Artificial Sequence: Synthetic peptide
QPLKPFSESR

SEQ ID NO: 1349 - protein, 8 aa, Artificial Sequence
  Description of Artificial Sequence: Synthetic peptide
YDITKVLK

SEQ ID NO: 1350 - protein, 8 aa, Artificial Sequence
  Description of Artificial Sequence: Synthetic peptide
KKPYNAAK

SEQ ID NO: 1351 - protein, 12 aa, Artificial Sequence
  Description of Artificial Sequence: Synthetic peptide
KVQPGHHTRLME

SEQ ID NO: 1352 - protein, 16 aa, Artificial Sequence
  Description of Artificial Sequence: Synthetic peptide
RFQNDKSVDGYQATVE

SEQ ID NO: 1353 - protein, 21 aa, Artificial Sequence
  Description of Artificial Sequence: Synthetic peptide
ITQQLHDLDLHVGDNFFLKYE

SEQ ID NO: 1354 - protein, 12 aa, Artificial Sequence
  Description of Artificial Sequence: Synthetic peptide
SIRSAFLQIQKE

SEQ ID NO: 1355 - protein, 13 aa, Artificial Sequence
  Description of Artificial Sequence: Synthetic peptide
NIAKFHGKPGLCE

SEQ ID NO: 1356 - protein, 20 aa, Artificial Sequence
  Description of Artificial Sequence: Synthetic peptide
NAVTSRDPQPELWDNKDFYE

SEQ ID NO: 1357 - protein, 16 aa, Artificial Sequence
  Description of Artificial Sequence: Synthetic peptide
FSKPEDTFDYHRFGYE

SEQ ID NO: 1358 - protein, 18 aa, Artificial Sequence
  Description of Artificial Sequence: Synthetic peptide
FVGMSVSSLHNYIKQQQE

SEQ ID NO: 1359 - protein, 8 aa, Artificial Sequence
  Description of Artificial Sequence: Synthetic peptide
APFFIKVE

SEQ ID NO: 1360 - protein, 5 aa, Artificial Sequence
  Description of Artificial Sequence: Synthetic peptide
RALKE

SEQ ID NO: 1361 - protein, 20 aa, Artificial Sequence
  Description of Artificial Sequence: Synthetic peptide
LDHAYSLRDGHYYIAGPTKD

SEQ ID NO: 1362 - protein, 20 aa, Artificial Sequence
  Description of Artificial Sequence: Synthetic peptide
DLTREHAKPADSFDYGRLGY

SEQ ID NO: 1363 - protein, 10 aa, Artificial Sequence
  Description of Artificial Sequence: Synthetic peptide
LLGGPTEMKW

SEQ ID NO: 1364 - protein, 12 aa, Artificial Sequence
  Description of Artificial Sequence: Synthetic peptide
DKPPVPVAQANL

SEQ ID NO: 1365 - protein, 7 aa, Artificial Sequence
  Description of Artificial Sequence: Synthetic peptide
VGGSEKY

SEQ ID NO: 1366 - protein, 6 aa, Artificial Sequence
  Description of Artificial Sequence: Synthetic peptide
QALQKY

SEQ ID NO: 1367 - protein, 19 aa, Artificial Sequence
  Description of Artificial Sequence: Synthetic peptide
KYEITQQLHDLDLHVGDNF

SEQ ID NO: 1368 - protein, 6 aa, Artificial Sequence
  Description of Artificial Sequence: Synthetic peptide
DNKDFY

SEQ ID NO: 1369 - protein, 18 aa, Artificial Sequence
  Description of Artificial Sequence: Synthetic peptide
ICVEQGGEQNCKTKAGSF

SEQ ID NO: 1370 - protein, 7 aa, Artificial Sequence
  Description of Artificial Sequence: Synthetic peptide
TTLEKHF

SEQ ID NO: 1371 - protein, 12 aa, Artificial Sequence
  Description of Artificial Sequence: Synthetic peptide
KNMQADDSPDGY

SEQ ID NO: 1372 - protein, 15 aa, Artificial Sequence
  Description of Artificial Sequence: Synthetic peptide
KPQSALPDLVTQETY

SEQ ID NO: 1373 - protein, 9 aa, Artificial Sequence
  Description of Artificial Sequence: Synthetic peptide
SHKTFPNPF

SEQ ID NO: 1374 - protein, 14 aa, Artificial Sequence
  Description of Artificial Sequence: Synthetic peptide
HNYIKQQQEADRVF

SEQ ID NO: 1375 - protein, 5 aa, Artificial Sequence
  Description of Artificial Sequence: Synthetic peptide
LLKGF

SEQ ID NO: 1376 - protein, 8 aa, Artificial Sequence
  Description of Artificial Sequence: Synthetic peptide
KYDITQAL

SEQ ID NO: 1377 - protein, 17 aa, Artificial Sequence
  Description of Artificial Sequence: Synthetic peptide
KAQSIHPEDVFDTDAPF

SEQ ID NO: 1378 - protein, 7 aa, Artificial Sequence
  Description of Artificial Sequence: Synthetic peptide
KQPLKPF

SEQ ID NO: 1379 - protein, 8 aa, Artificial Sequence
  Description of Artificial Sequence: Synthetic peptide
RYDITKVL

SEQ ID NO: 1380 - protein, 8 aa, Artificial Sequence
  Description of Artificial Sequence: Synthetic peptide
TSANVKIY

SEQ ID NO: 1381 - protein, 8 aa, Artificial Sequence
  Description of Artificial Sequence: Synthetic peptide
IAGPTKDL

SEQ ID NO: 1382 - protein, 8 aa, Artificial Sequence
  Description of Artificial Sequence: Synthetic peptide
LEQDEFCK

SEQ ID NO: 1383 - protein, 14 aa, Artificial Sequence
  Description of Artificial Sequence: Synthetic peptide
LRGKDPNSADCAHN

SEQ ID NO: 1384 - protein, 11 aa, Artificial Sequence
  Description of Artificial Sequence: Synthetic peptide
AKPADSFDYGR

SEQ ID NO: 1385 - protein, 8 aa, Artificial Sequence
  Description of Artificial Sequence: Synthetic peptide
LGGPTEMK

SEQ ID NO: 1386 - protein, 6 aa, Artificial Sequence
  Description of Artificial Sequence: Synthetic peptide
FQNDKS

SEQ ID NO: 1387 - protein, 8 aa, Artificial Sequence
  Description of Artificial Sequence: Synthetic peptide
VGGSEKYS

SEQ ID NO: 1388 - protein, 12 aa, Artificial Sequence
  Description of Artificial Sequence: Synthetic peptide
FHGEPKWCPSPE

SEQ ID NO: 1389 - protein, 9 aa, Artificial Sequence
  Description of Artificial Sequence: Synthetic peptide
IQKEGIYEN

SEQ ID NO: 1390 - protein, 6 aa, Artificial Sequence
  Description of Artificial Sequence: Synthetic peptide
LWDNKD

SEQ ID NO: 1391 - protein, 15 aa, Artificial Sequence
  Description of Artificial Sequence: Synthetic peptide
LKHNLPQDSFDYQNR

SEQ ID NO: 1392 - protein, 17 aa, Artificial Sequence
  Description of Artificial Sequence: Synthetic peptide
ICVEQGGEQNCKTKAGS

SEQ ID NO: 1393 - protein, 17 aa, Artificial Sequence
  Description of Artificial Sequence: Synthetic peptide
ICVEQGGEQNCKTKAGS

SEQ ID NO: 1394 - protein, 10 aa, Artificial Sequence
  Description of Artificial Sequence: Synthetic peptide
FSHKTFPNPF

SEQ ID NO: 1395 - protein, 12 aa, Artificial Sequence
  Description of Artificial Sequence: Synthetic peptide
FSKPEDTFDYHR

SEQ ID NO: 1396 - protein, 10 aa, Artificial Sequence
  Description of Artificial Sequence: Synthetic peptide
IKQQQEADRV

SEQ ID NO: 1397 - protein, 7 aa, Artificial Sequence
  Description of Artificial Sequence: Synthetic peptide
YWDWTKP

SEQ ID NO: 1398 - protein, 7 aa, Artificial Sequence
  Description of Artificial Sequence: Synthetic peptide
ISKLPDL

SEQ ID NO: 1399 - protein, 5 aa, Artificial Sequence
  Description of Artificial Sequence: Synthetic peptide
FAKGY

SEQ ID NO: 1400 - protein, 8 aa, Artificial Sequence
  Description of Artificial Sequence: Synthetic peptide
IKSEDAYT

SEQ ID NO: 1401 - protein, 5 aa, Artificial Sequence
  Description of Artificial Sequence: Synthetic peptide
FTKMH

SEQ ID NO: 1402 - protein, 10 aa, Artificial Sequence
  Description of Artificial Sequence: Synthetic peptide
LDEANDLKNA

SEQ ID NO: 1403 - protein, 7 aa, Artificial Sequence
  Description of Artificial Sequence: Synthetic peptide
LKEHGSH

SEQ ID NO: 1404 - protein, 7 aa, Artificial Sequence
  Description of Artificial Sequence: Synthetic peptide
IAGPTKD

SEQ ID NO: 1405 - protein, 18 aa, Artificial Sequence
  Description of Artificial Sequence: Synthetic peptide
GFTDPPVKHHQSANLLVR

SEQ ID NO: 1406 - protein, 8 aa, Artificial Sequence
  Description of Artificial Sequence: Synthetic peptide
KNINDLTR

SEQ ID NO: 1407 - protein, 10 aa, Artificial Sequence
  Description of Artificial Sequence: Synthetic peptide
EAFHKFQEDR

SEQ ID NO: 1408 - protein, 30 aa, Artificial Sequence
  Description of Artificial Sequence: Synthetic polypeptide
TYVDSHGASHTNPFHSSVIAFEENAPHTKR

SEQ ID NO: 1409 - protein, 18 aa, Artificial Sequence
  Description of Artificial Sequence: Synthetic peptide
TSANVDIFIKTTDSVQHK

SEQ ID NO: 1410 - protein, 19 aa, Artificial Sequence
  Description of Artificial Sequence: Synthetic peptide
TTDSVQHKAGTFAVLGGSK

SEQ ID NO: 1411 - protein, 8 aa, Artificial Sequence
  Description of Artificial Sequence: Synthetic peptide
VKFDKVPR

SEQ ID NO: 1412 - protein, 8 aa, Artificial Sequence
  Description of Artificial Sequence: Synthetic peptide
VKFDKVPR

SEQ ID NO: 1413 - protein, 5 aa, Artificial Sequence
  Description of Artificial Sequence: Synthetic peptide
KNVDR

SEQ ID NO: 1414 - protein, 7 aa, Artificial Sequence
  Description of Artificial Sequence: Synthetic peptide
KALALLK

SEQ ID NO: 1415 - protein, 19 aa, Artificial Sequence
  Description of Artificial Sequence: Synthetic peptide
EDKSAGGFQQLGAFHGEPK

SEQ ID NO: 1416 - protein, 25 aa, Artificial Sequence
  Description of Artificial Sequence: Synthetic peptide
SAGGFQQLGAFHGEPKWCPSPEASK

SEQ ID NO: 1417 - protein, 37 aa, Artificial Sequence; identical to SEQ ID NO: 176
  Description of Artificial Sequence: Synthetic polypeptide

SEQ ID NO: 1418 - protein, 18 aa, Artificial Sequence
  Description of Artificial Sequence: Synthetic peptide
HNPWFDGHIDTVDKTTTR

SEQ ID NO: 1419 - protein, 20 aa, Artificial Sequence
  Description of Artificial Sequence: Synthetic peptide
SVQNKLFEQPEFGHYTSIAK

SEQ ID NO: 1420 - protein, 15 aa, Artificial Sequence
  Description of Artificial Sequence: Synthetic peptide
GKPYNVANCAVTSMR

SEQ ID NO: 1421 - protein, 31 aa, Artificial Sequence
  Description of Artificial Sequence: Synthetic polypeptide
EPLQPFGLSANINTDHVTKEHSVPFNVFDYK

SEQ ID NO: 1422 - protein, 6 aa, Artificial Sequence
  Description of Artificial Sequence: Synthetic peptide
KLEAIK

SEQ ID NO: 1423 - protein, 6 aa, Artificial Sequence
  Description of Artificial Sequence: Synthetic peptide
KSSLVK

SEQ ID NO: 1424 - protein, 13 aa, Artificial Sequence
  Description of Artificial Sequence: Synthetic peptide
DLFKQPSVIHEPR

SEQ ID NO: 1425 - protein, 15 aa, Artificial Sequence
  Description of Artificial Sequence: Synthetic peptide
KNIENLSLGELESLR

SEQ ID NO: 1426 - protein, 13 aa, Artificial Sequence
  Description of Artificial Sequence: Synthetic peptide
LYVVVVENALLKK

SEQ ID NO: 1427 - protein, 23 aa, Artificial Sequence
  Description of Artificial Sequence: Synthetic peptide
QHHYETNPFHHGKITHENEITTR

SEQ ID NO: 1428 - protein, 5 aa, Artificial Sequence
  Description of Artificial Sequence: Synthetic peptide
KRPYR

SEQ ID NO: 1429 - protein, 8 aa, Artificial Sequence
  Description of Artificial Sequence: Synthetic peptide
LDITKALK

SEQ ID NO: 1430 - protein, 9 aa, Artificial Sequence
  Description of Artificial Sequence: Synthetic peptide
KDITQLDKR

SEQ ID NO: 1431 - protein, 9 aa, Artificial Sequence
  Description of Artificial Sequence: Synthetic peptide
KDITQLDKR

SEQ ID NO: 1432 - protein, 29 aa, Artificial Sequence
  Description of Artificial Sequence: Synthetic peptide
ADHSSDGFQAIASFHALPPLCPSPAASKR

SEQ ID NO: 1433 - protein, 17 aa, Artificial Sequence
  Description of Artificial Sequence: Synthetic peptide
KHGAVVGLPYWDWTLPR

SEQ ID NO: 1434 - protein, 26 aa, Artificial Sequence
  Description of Artificial Sequence: Synthetic peptide
TAGDCEDAGYFTVLGGEKEMPWAFDR

SEQ ID NO: 1435 - protein, 33 aa, Artificial Sequence; identical to SEQ ID NO: 626
  Description of Artificial Sequence: Synthetic polypeptide

SEQ ID NO: 1436 - protein, 10 aa, Artificial Sequence
  Description of Artificial Sequence: Synthetic peptide
NKVMPNPFAR

SEQ ID NO: 1437 - protein, 10 aa, Artificial Sequence
  Description of Artificial Sequence: Synthetic peptide
KHAVPNDVFK

SEQ ID NO: 1438 - protein, 16 aa, Artificial Sequence
  Description of Artificial Sequence: Synthetic peptide
HAVPNDVFKYELLGYR

SEQ ID NO: 1439 - protein, 10 aa, Artificial Sequence
  Description of Artificial Sequence: Synthetic peptide
EIKDKQHHVR

SEQ ID NO: 1440 - protein, 29 aa, Artificial Sequence
  Description of Artificial Sequence: Synthetic peptide
TSADVQFQICKTSEDCHHGGQIFVLGGTK

SEQ ID NO: 1441 - protein, 9 aa, Artificial Sequence
  Description of Artificial Sequence: Synthetic peptide
DKLFNDPER

SEQ ID NO: 1442 - protein, 30 aa, Artificial Sequence; identical to SEQ ID NO: 202
  Description of Artificial Sequence: Synthetic polypeptide

SEQ ID NO: 1443 - protein, 8 aa, Artificial Sequence
  Description of Artificial Sequence: Synthetic peptide
KLEHELEK

SEQ ID NO: 1444 - protein, 9 aa, Artificial Sequence
  Description of Artificial Sequence: Synthetic peptide
LEHELEKQK

SEQ ID NO: 1445 - protein, 15 aa, Artificial Sequence
  Description of Artificial Sequence: Synthetic peptide
IIDTSGKQLPSDLIK

SEQ ID NO: 1446 - protein, 16 aa, Artificial Sequence
  Description of Artificial Sequence: Synthetic peptide
HHEKHHEDHHEDILVR

SEQ ID NO: 1447 - protein, 15 aa, Artificial Sequence
  Description of Artificial Sequence: Synthetic peptide
KNIHSLSHHEAEELR

SEQ ID NO: 1448 - protein, 30 aa, Artificial Sequence; identical to SEQ ID NO: 638
  Description of Artificial Sequence: Synthetic polypeptide

SEQ ID NO: 1449 - protein, 35 aa, Artificial Sequence; identical to SEQ ID NO: 640
  Description of Artificial Sequence: Synthetic polypeptide

SEQ ID NO: 1450 - protein, 33 aa, Artificial Sequence; identical to SEQ ID NO: 13
  Description of Artificial Sequence: Synthetic polypeptide

SEQ ID NO: 1451 - protein, 23 aa, Artificial Sequence
  Description of Artificial Sequence: Synthetic peptide
FNYKYDNLNLHGHNIEELEEVLR

SEQ ID NO: 1452 - protein, 10 aa, Artificial Sequence
  Description of Artificial Sequence: Synthetic peptide
TTAVVKVYIK

SEQ ID NO: 1453 - protein, 19 aa, Artificial Sequence
  Description of Artificial Sequence: Synthetic peptide
KYDHTELDASVLPAPIIVR

SEQ ID NO: 1454 - protein, 23 aa, Artificial Sequence
  Description of Artificial Sequence: Synthetic peptide
RPNNAVFDIIEIPIGKDVNLPPK

SEQ ID NO: 1455 - protein, 29 aa, Artificial Sequence
  Description of Artificial Sequence: Synthetic peptide
KGFTDPPVKHHQSANLLVRKNINDLTREE

SEQ ID NO: 1456 - protein, 29 aa, Artificial Sequence
  Description of Artificial Sequence: Synthetic peptide
KGFTDPPVKHHQSANLLVRKNINDLTREE

SEQ ID NO: 1457 - protein, 19 aa, Artificial Sequence
  Description of Artificial Sequence: Synthetic peptide
AFHKFQEDRSVDGYQATAE

SEQ ID NO: 1458 - protein, 19 aa, Artificial Sequence
  Description of Artificial Sequence: Synthetic peptide
VDGTKLASSLIPHASVIRE

SEQ ID NO: 1459 - protein, 24 aa, Artificial Sequence
  Description of Artificial Sequence: Synthetic peptide
DKSAGGFQQLGAFHGEPKWCPSPE

SEQ ID NO: 1460 - protein, 17 aa, Artificial Sequence
  Description of Artificial Sequence: Synthetic peptide
HSVPFNVFDYKTNFNYE

SEQ ID NO: 1461 - protein, 31 aa, Artificial Sequence; identical to SEQ ID NO: 224
  Description of Artificial Sequence: Synthetic polypeptide

SEQ ID NO: 1462 - protein, 29 aa, Artificial Sequence
  Description of Artificial Sequence: Synthetic peptide
VFDLKPASLGKDLFKQPSVIHEPRIGHHE

SEQ ID NO: 1463 - protein, 22 aa, Artificial Sequence
  Description of Artificial Sequence: Synthetic peptide
NALLKKGSSVAVPYWDWTKRIE

SEQ ID NO: 1464 - protein, 17 aa, Artificial Sequence
  Description of Artificial Sequence: Synthetic peptide
ITQLDKRQQLSLVKALE

SEQ ID NO: 1465 - protein, 17 aa, Artificial Sequence
  Description of Artificial Sequence: Synthetic peptide
TGRDIPNPFIGSKIEFE

SEQ ID NO: 1466 - protein, 11 aa, Artificial Sequence
  Description of Artificial Sequence: Synthetic peptide
TLDKMNLRHDE

SEQ ID NO: 1467 - protein, 15 aa, Artificial Sequence
  Description of Artificial Sequence: Synthetic peptide
AEELRDALYKLQNDE

SEQ ID NO: 1468 - protein, 10 aa, Artificial Sequence
  Description of Artificial Sequence: Synthetic peptide
VLGGPSEMKW

SEQ ID NO: 1469 - protein, 7 aa, Artificial Sequence
  Description of Artificial Sequence: Synthetic peptide
TVKAELF

SEQ ID NO: 1470 - protein, 12 aa, Artificial Sequence
  Description of Artificial Sequence: Synthetic peptide
HKFQEDRSVDGY

SEQ ID NO: 1471 - protein, 22 aa, Artificial Sequence
  Description of Artificial Sequence: Synthetic peptide
GGISLENIEKMIHENQQEDRIY

SEQ ID NO: 1472 - protein, 12 aa, Artificial Sequence
  Description of Artificial Sequence: Synthetic peptide
ALLKEDKSAGGF

SEQ ID NO: 1473 - protein, 9 aa, Artificial Sequence
  Description of Artificial Sequence: Synthetic peptide
TSIAKQVLL

SEQ ID NO: 1474 - protein, 6 aa, Artificial Sequence
  Description of Artificial Sequence: Synthetic peptide
QALQKY

SEQ ID NO: 1475 - protein, 9 aa, Artificial Sequence
  Description of Artificial Sequence: Synthetic peptide
NVFDYKTNF

SEQ ID NO: 1476 - protein, 11 aa, Artificial Sequence
  Description of Artificial Sequence: Synthetic peptide
KYDITEKLHDL

SEQ ID NO: 1477 - protein, 12 aa, Artificial Sequence
  Description of Artificial Sequence: Synthetic peptide
DLKPASLGKDLF

SEQ ID NO: 1478 - protein, 6 aa, Artificial Sequence
  Description of Artificial Sequence: Synthetic peptide
ESIAKF

SEQ ID NO: 1479 - protein, 8 aa, Artificial Sequence
  Description of Artificial Sequence: Synthetic peptide
KLDITKAL

SEQ ID NO: 1480 - protein, 16 aa, Artificial Sequence
  Description of Artificial Sequence: Synthetic peptide
NLNDHTHDFSKPEDTF

SEQ ID NO: 1481 - protein, 21 aa, Artificial Sequence
  Description of Artificial Sequence: Synthetic peptide
NLNDHTHDFSKPEDTFDYQKF

SEQ ID NO: 1482 - protein, 11 aa, Artificial Sequence
  Description of Artificial Sequence: Synthetic peptide
TVLGGEKEMPW

SEQ ID NO: 1483 - protein, 10 aa, Artificial Sequence
  Description of Artificial Sequence: Synthetic peptide
SERDIGSLKY

SEQ ID NO: 1484 - protein, 9 aa, Artificial Sequence
  Description of Artificial Sequence: Synthetic peptide
TDKEYYDVW

SEQ ID NO: 1485 - protein, 13 aa, Artificial Sequence
  Description of Artificial Sequence: Synthetic peptide
THSNAKPTDVFEY

SEQ ID NO: 1486 - protein, 11 aa, Artificial Sequence
  Description of Artificial Sequence: Synthetic peptide
KLQNDESHGGY

SEQ ID NO: 1487 - protein, 11 aa, Artificial Sequence
  Description of Artificial Sequence: Synthetic peptide
KKHGSHLGIPY

SEQ ID NO: 1488 - protein, 7 aa, Artificial Sequence
  Description of Artificial Sequence: Synthetic peptide
IGGAEKY

SEQ ID NO: 1489 - protein, 15 aa, Artificial Sequence
  Description of Artificial Sequence: Synthetic peptide
IKSGTDSDDEYAGSF

SEQ ID NO: 1490 - protein, 11 aa, Artificial Sequence
  Description of Artificial Sequence: Synthetic peptide
VILGGAKEMPW

SEQ ID NO: 1491 - protein, 9 aa, Artificial Sequence
  Description of Artificial Sequence: Synthetic peptide
MTPEELKTY

SEQ ID NO: 1492 - protein, 19 aa, Artificial Sequence
  Description of Artificial Sequence: Synthetic peptide
VCIPDDNDRNDDHCEKAGD

SEQ ID NO: 1493 - protein, 11 aa, Artificial Sequence
  Description of Artificial Sequence: Synthetic peptide
VLGGPSEMKWQ

SEQ ID NO: 1494 - protein, 7 aa, Artificial Sequence
  Description of Artificial Sequence: Synthetic peptide
LSDTVHK

SEQ ID NO: 1495 - protein, 7 aa, Artificial Sequence
  Description of Artificial Sequence: Synthetic peptide
VHHPEKG

SEQ ID NO: 1496 - protein, 11 aa, Artificial Sequence
  Description of Artificial Sequence: Synthetic peptide
FTDPPVKHHQS

SEQ ID NO: 1497 - protein, 11 aa, Artificial Sequence
  Description of Artificial Sequence: Synthetic peptide
FEENAPHTKRQ

SEQ ID NO: 1498 - protein, 9 aa, Artificial Sequence
  Description of Artificial Sequence: Synthetic peptide
ISLENIEKM

SEQ ID NO: 1499 - protein, 10 aa, Artificial Sequence
  Description of Artificial Sequence: Synthetic peptide
VDITEVDGTK

SEQ ID NO: 1500 - protein, 7 aa, Artificial Sequence
  Description of Artificial Sequence: Synthetic peptide
LLKEDKS

SEQ ID NO: 1501 - protein, 12 aa, Artificial Sequence
  Description of Artificial Sequence: Synthetic peptide
FHGEPKWCPSPE

SEQ ID NO: 1502 - protein, 7 aa, Artificial Sequence
  Description of Artificial Sequence: Synthetic peptide
LADHEKY

SEQ ID NO: 1503 - protein, 8 aa, Artificial Sequence
  Description of Artificial Sequence: Synthetic peptide
VTKEHSVP

SEQ ID NO: 1504 - protein, 6 aa, Artificial Sequence
  Description of Artificial Sequence: Synthetic peptide
FDYKTN

SEQ ID NO: 1505 - protein, 6 aa, Artificial Sequence
  Description of Artificial Sequence: Synthetic peptide
LFKQPS

SEQ ID NO: 1506 - protein, 10 aa, Artificial Sequence
  Description of Artificial Sequence: Synthetic peptide
ITTRDPKDSL

SEQ ID NO: 1507 - protein, 9 aa, Artificial Sequence
  Description of Artificial Sequence: Synthetic peptide
LLGGKGKYS

SEQ ID NO: 1508 - protein, 14 aa, Artificial Sequence
  Description of Artificial Sequence: Synthetic peptide
FDKSDNNDEATKTH

SEQ ID NO: 1509 - protein, 9 aa, Artificial Sequence
  Description of Artificial Sequence: Synthetic peptide
WVGGKEPYG

SEQ ID NO: 1510 - protein, 12 aa, Artificial Sequence
  Description of Artificial Sequence: Synthetic peptide
FSKPEDTFDYQK

SEQ ID NO: 1511 - protein, 12 aa, Artificial Sequence
  Description of Artificial Sequence: Synthetic peptide
FSKPEDTFDYQK

SEQ ID NO: 1512 - protein, 9 aa, Artificial Sequence
  Description of Artificial Sequence: Synthetic peptide
VLGGEKEMP

SEQ ID NO: 1513 - protein, 11 aa, Artificial Sequence
  Description of Artificial Sequence: Synthetic peptide
VAVPYWDWTKP

SEQ ID NO: 1514 - protein, 5 aa, Artificial Sequence
  Description of Artificial Sequence: Synthetic peptide
FTKKH

SEQ ID NO: 1515 - protein, 7 aa, Artificial Sequence
  Description of Artificial Sequence: Synthetic peptide
LHEIEKE

SEQ ID NO: 1516 - protein, 13 aa, Artificial Sequence
  Description of Artificial Sequence: Synthetic peptide
ICKTSEDCHHGGQ

SEQ ID NO: 1517 - protein, 12 aa, Artificial Sequence
  Description of Artificial Sequence: Synthetic peptide
LTTAEVDNLKDA

SEQ ID NO: 1518 - protein, 8 aa, Artificial Sequence
  Description of Artificial Sequence: Synthetic peptide
AKPTDVFE

SEQ ID NO: 1519 - protein, 10 aa, Artificial Sequence
  Description of Artificial Sequence: Synthetic peptide
LEKQKEEDRT

SEQ ID NO: 1520 - protein, 12 aa, Artificial Sequence
  Description of Artificial Sequence: Synthetic peptide
IIDTSGKQLPSD

SEQ ID NO: 1521 - protein, 6 aa, Artificial Sequence
  Description of Artificial Sequence: Synthetic peptide
LIKMPT

SEQ ID NO: 1522 - protein, 6 aa, Artificial Sequence
  Description of Artificial Sequence: Synthetic peptide
IFQQTK

SEQ ID NO: 1523 - protein, 8 aa, Artificial Sequence
  Description of Artificial Sequence: Synthetic peptide
IGGAEKYS

SEQ ID NO: 1524 - protein, 15 aa, Artificial Sequence
  Description of Artificial Sequence: Synthetic peptide
IKSGTDSDDEYAGSF

SEQ ID NO: 1525 - protein, 7 aa, Artificial Sequence
  Description of Artificial Sequence: Synthetic peptide
LTDDHVK

SEQ ID NO: 1526 - protein, 16 aa, Artificial Sequence
  Description of Artificial Sequence: Synthetic peptide
KNVDSLSSDEVLALEK

SEQ ID NO: 1527 - protein, 9 aa, Artificial Sequence
  Description of Artificial Sequence: Synthetic peptide
ADITFLNKK

SEQ ID NO: 1528 - protein, 12 aa, Artificial Sequence
  Description of Artificial Sequence: Synthetic peptide
LFEKVQPGHHTR

SEQ ID NO: 1529 - protein, 23 aa, Artificial Sequence
  Description of Artificial Sequence: Synthetic peptide
GKDPNSADCAHNLIHTPMEPFDR

SEQ ID NO: 1530 - protein, 13 aa, Artificial Sequence
  Description of Artificial Sequence: Synthetic peptide
EHAKPADSFDYGR

SEQ ID NO: 1531 - protein, 19 aa, Artificial Sequence
  Description of Artificial Sequence: Synthetic peptide
AGDFFLLGGPTEMKWGFYR

SEQ ID NO: 1532 - protein, 28 aa, Artificial Sequence
  Description of Artificial Sequence: Synthetic peptide
QPTLVHRPAKGHFDKPPVPVAQANLAVR

SEQ ID NO: 1533 - protein, 18 aa, Artificial Sequence
  Description of Artificial Sequence: Synthetic peptide
GHFDKPPVPVAQANLAVR

SEQ ID NO: 1534 - protein, 22 aa, Artificial Sequence
  Description of Artificial Sequence: Synthetic peptide
FQNDKSVDGYQATVEFHALPAR

SEQ ID NO: 1535 - protein, 17 aa, Artificial Sequence
  Description of Artificial Sequence: Synthetic peptide
KFACCVHGMAVFPHWHR

SEQ ID NO: 1536 - protein, 15 aa, Artificial Sequence
  Description of Artificial Sequence: Synthetic peptide
KHGFTGGLPYWDWTR

SEQ ID NO: 1537 - protein, 15 aa, Artificial Sequence
  Description of Artificial Sequence: Synthetic peptide
GKPYNTANCAIASMR

SEQ ID NO: 1538 - protein, 19 aa, Artificial Sequence
  Description of Artificial Sequence: Synthetic peptide
KPLQPFGLDSVINPDDETR

SEQ ID NO: 1539 - protein, 27 aa, Artificial Sequence
  Description of Artificial Sequence: Synthetic peptide
VFDYKNNFDYEYESLAFNGLSIAQLDR

SEQ ID NO: 1540 - protein, 17 aa, Artificial Sequence
  Description of Artificial Sequence: Synthetic peptide
SAFLQIQKEGIYENIAK

SEQ ID NO: 1541 - protein, 31 aa, Artificial Sequence; identical to SEQ ID NO: 25
  Description of Artificial Sequence: Synthetic polypeptide

SEQ ID NO: 1542 - protein, 42 aa, Artificial Sequence; identical to SEQ ID NO: 308
  Description of Artificial Sequence: Synthetic polypeptide

SEQ ID NO: 1543 - protein, 26 aa, Artificial Sequence
  Description of Artificial Sequence: Synthetic peptide
AKYSLSSLDYTAFDPVFFLHHANVDR

SEQ ID NO: 1544 - protein, 15 aa, Artificial Sequence
  Description of Artificial Sequence: Synthetic peptide
KKPYNEADCAVNEMR

SEQ ID NO: 1545 - protein, 32 aa, Artificial Sequence; identical to SEQ ID NO: 27
  Description of Artificial Sequence: Synthetic polypeptide

SEQ ID NO: 1546 - protein, 23 aa, Artificial Sequence
  Description of Artificial Sequence: Synthetic peptide
YQYDNLQFNHFSIQKLDQTIQAR

SEQ ID NO: 1547 - protein, 22 aa, Artificial Sequence
  Description of Artificial Sequence: Synthetic peptide
FDITSALHKLGVPLDGHGFDIK

SEQ ID NO: 1548 - protein, 12 aa, Artificial Sequence
  Description of Artificial Sequence: Synthetic peptide
LYTVQFEDSLKR

SEQ ID NO: 1549 - protein, 15 aa, Artificial Sequence
  Description of Artificial Sequence: Synthetic peptide
TQEFSKPEDTFDYHR

SEQ ID NO: 1550 - protein, 8 aa, Artificial Sequence
  Description of Artificial Sequence: Synthetic peptide
YDITKTLK

SEQ ID NO: 1551 - protein, 12 aa, Artificial Sequence
  Description of Artificial Sequence: Synthetic peptide
YDDTFTIKVHIK

SEQ ID NO: 1552 - protein, 12 aa, Artificial Sequence
  Description of Artificial Sequence: Synthetic peptide
GYIKSEDAYTVR

SEQ ID NO: 1553 - protein, 15 aa, Artificial Sequence
  Description of Artificial Sequence: Synthetic peptide
KDVTSLTASEIENLR

SEQ ID NO: 1554 - protein, 10 aa, Artificial Sequence
  Description of Artificial Sequence: Synthetic peptide
QPLKPFSESR

SEQ ID NO: 1555 - protein, 8 aa, Artificial Sequence
  Description of Artificial Sequence: Synthetic peptide
YDITKVLK

SEQ ID NO: 1556 - protein, 8 aa, Artificial Sequence
  Description of Artificial Sequence: Synthetic peptide
KKPYNAAK

SEQ ID NO: 1557 - protein, 16 aa, Artificial Sequence
  Description of Artificial Sequence: Synthetic peptide
RFQNDKSVDGYQATVE

SEQ ID NO: 1558 - protein, 21 aa, Artificial Sequence
  Description of Artificial Sequence: Synthetic peptide
ITQQLHDLDLHVGDNFFLKYE

SEQ ID NO: 1559 - protein, 8 aa, Artificial Sequence
  Description of Artificial Sequence: Synthetic peptide
APFFIKVE

SEQ ID NO: 1560 - protein, 12 aa, Artificial Sequence
  Description of Artificial Sequence: Synthetic peptide
SIRSAFLQIQKE

SEQ ID NO: 1561 - protein, 12 aa, Artificial Sequence
  Description of Artificial Sequence: Synthetic peptide
SIRSAFLQIQKE

SEQ ID NO: 1562 - protein, 12 aa, Artificial Sequence
  Description of Artificial Sequence: Synthetic peptide
SIRSAFLQIQKE

SEQ ID NO: 1563 - protein, 12 aa, Artificial Sequence
  Description of Artificial Sequence: Synthetic peptide
SIRSAFLQIQKE

SEQ ID NO: 1564 - protein, 13 aa, Artificial Sequence
  Description of Artificial Sequence: Synthetic peptide
NIAKFHGKPGLCE

SEQ ID NO: 1565 - protein, 14 aa, Artificial Sequence
  Description of Artificial Sequence: Synthetic peptide
IESIRSAFLQIQKE

SEQ ID NO: 1566 - protein, 14 aa, Artificial Sequence
  Description of Artificial Sequence: Synthetic peptide
IESIRSAFLQIQKE

SEQ ID NO: 1567 - protein, 16 aa, Artificial Sequence
  Description of Artificial Sequence: Synthetic peptide
RFQNDKSVDGYQATVE

SEQ ID NO: 1568 - protein, 16 aa, Artificial Sequence
  Description of Artificial Sequence: Synthetic peptide
RFQNDKSVDGYQATVE

SEQ ID NO: 1569 - protein, 16 aa, Artificial Sequence
  Description of Artificial Sequence: Synthetic peptide
RFQNDKSVDGYQATVE

SEQ ID NO: 1570 - protein, 16 aa, Artificial Sequence
  Description of Artificial Sequence: Synthetic peptide
FSKPEDTFDYHRFGYE

SEQ ID NO: 1571 - protein, 16 aa, Artificial Sequence
  Description of Artificial Sequence: Synthetic peptide
FSKPEDTFDYHRFGYE

SEQ ID NO: 1572 - protein, 20 aa, Artificial Sequence
  Description of Artificial Sequence: Synthetic peptide
LDHAYSLRDGHYYIAGPTKD

SEQ ID NO: 1573 - protein, 20 aa, Artificial Sequence
  Description of Artificial Sequence: Synthetic peptide
LDHAYSLRDGHYYIAGPTKD

SEQ ID NO: 1574 - protein, 20 aa, Artificial Sequence
  Description of Artificial Sequence: Synthetic peptide
NAVTSRDPQPELWDNKDFYE

SEQ ID NO: 1575 - protein, 21 aa, Artificial Sequence
  Description of Artificial Sequence: Synthetic peptide
ITQQLHDLDLHVGDNFFLKYE

SEQ ID NO: 1576 - protein, 21 aa, Artificial Sequence
  Description of Artificial Sequence: Synthetic peptide
ITQQLHDLDLHVGDNFFLKYE

SEQ ID NO: 1577 - protein, 18 aa, Artificial Sequence
  Description of Artificial Sequence: Synthetic peptide
FVGMSVSSLHNYIKQQQE

SEQ ID NO: 1578 - protein, 20 aa, Artificial Sequence
  Description of Artificial Sequence: Synthetic peptide
DLTREHAKPADSFDYGRLGY

SEQ ID NO: 1579 - protein, 11 aa, Artificial Sequence
  Description of Artificial Sequence: Synthetic peptide
LGERAAKERTF

SEQ ID NO: 1580 - protein, 7 aa, Artificial Sequence
  Description of Artificial Sequence: Synthetic peptide
VGGSEKY

SEQ ID NO: 1581 - protein, 6 aa, Artificial Sequence
  Description of Artificial Sequence: Synthetic peptide
QALQKY

SEQ ID NO: 1582 - protein, 10 aa, Artificial Sequence
  Description of Artificial Sequence: Synthetic peptide
DYKNNFDYEY

SEQ ID NO: 1583 - protein, 13 aa, Artificial Sequence
  Description of Artificial Sequence: Synthetic peptide
LLHEIGQSALVKF

SEQ ID NO: 1584 - protein, 15 aa, Artificial Sequence
  Description of Artificial Sequence: Synthetic peptide
KHNLPQDSFDYQNRF

SEQ ID NO: 1585 - protein, 7 aa, Artificial Sequence
  Description of Artificial Sequence: Synthetic peptide
TTLEKHF

SEQ ID NO: 1586 - protein, 12 aa, Artificial Sequence
  Description of Artificial Sequence: Synthetic peptide
KNMQADDSPDGY

SEQ ID NO: 1587 - protein, 9 aa, Artificial Sequence
  Description of Artificial Sequence: Synthetic peptide
SHKTFPNPF

SEQ ID NO: 1588 - protein, 11 aa, Artificial Sequence
  Description of Artificial Sequence: Synthetic peptide
IKQQQEADRVF

SEQ ID NO: 1589 - protein, 11 aa, Artificial Sequence
  Description of Artificial Sequence: Synthetic peptide
KGFGQSASVSF

SEQ ID NO: 1590 - protein, 17 aa, Artificial Sequence
  Description of Artificial Sequence: Synthetic peptide
KAQSIHPEDVFDTDAPF

SEQ ID NO: 1591 - protein, 7 aa, Artificial Sequence
  Description of Artificial Sequence: Synthetic peptide
KQPLKPF

SEQ ID NO: 1592 - protein, 7 aa, Artificial Sequence
  Description of Artificial Sequence: Synthetic peptide
KQPLKPF

SEQ ID NO: 1593 - protein, 8 aa, Artificial Sequence
  Description of Artificial Sequence: Synthetic peptide
RYDITKVL

SEQ ID NO: 1594 - protein, 8 aa, Artificial Sequence
  Description of Artificial Sequence: Synthetic peptide
TSANVKIY

SEQ ID NO: 1595 - protein, 8 aa, Artificial Sequence
  Description of Artificial Sequence: Synthetic peptide
IAGPTKDL

SEQ ID NO: 1596 - protein, 8 aa, Artificial Sequence
  Description of Artificial Sequence: Synthetic peptide
LEQDEFCK

SEQ ID NO: 1597 - protein, 11 aa, Artificial Sequence
  Description of Artificial Sequence: Synthetic peptide
LRGKDPNSADC

SEQ ID NO: 1598 - protein, 11 aa, Artificial Sequence
  Description of Artificial Sequence: Synthetic peptide
AKPADSFDYGR

SEQ ID NO: 1599 - protein, 8 aa, Artificial Sequence
  Description of Artificial Sequence: Synthetic peptide
LGGPTEMK

SEQ ID NO: 1600 - protein, 7 aa, Artificial Sequence
  Description of Artificial Sequence: Synthetic peptide
FDKPPVP

SEQ ID NO: 1601 - protein, 8 aa, Artificial Sequence
  Description of Artificial Sequence: Synthetic peptide
VGGSEKYS

SEQ ID NO: 1602 - protein, 12 aa, Artificial Sequence
  Description of Artificial Sequence: Synthetic peptide
FHGEPKWCPSPE

SEQ ID NO: 1603 - protein, 6 aa, Artificial Sequence
  Description of Artificial Sequence: Synthetic peptide
FDYKNN

SEQ ID NO: 1604 - protein, 15 aa, Artificial Sequence
  Description of Artificial Sequence: Synthetic peptide
LKHNLPQDSFDYQNR

SEQ ID NO: 1605 - protein, 17 aa, Artificial Sequence
  Description of Artificial Sequence: Synthetic peptide
ICVEQGGEQNCKTKAGS

SEQ ID NO: 1606 - protein, 17 aa, Artificial Sequence
  Description of Artificial Sequence: Synthetic peptide
ICVEQGGEQNCKTKAGS

SEQ ID NO: 1607 - protein, 10 aa, Artificial Sequence
  Description of Artificial Sequence: Synthetic peptide
FSHKTFPNPF

SEQ ID NO: 1608 - protein, 12 aa, Artificial Sequence
  Description of Artificial Sequence: Synthetic peptide
FSKPEDTFDYHR

SEQ ID NO: 1609 - protein, 10 aa, Artificial Sequence
  Description of Artificial Sequence: Synthetic peptide
IKQQQEADRV

SEQ ID NO: 1610 - protein, 7 aa, Artificial Sequence
  Description of Artificial Sequence: Synthetic peptide
YWDWTKP

SEQ ID NO: 1611 - protein, 7 aa, Artificial Sequence
  Description of Artificial Sequence: Synthetic peptide
ISKLPDL

SEQ ID NO: 1612 - protein, 5 aa, Artificial Sequence
  Description of Artificial Sequence: Synthetic peptide
FAKGY

SEQ ID NO: 1613 - protein, 10 aa, Artificial Sequence
  Description of Artificial Sequence: Synthetic peptide
LDEANDLKNA

SEQ ID NO: 1614 - protein, 7 aa, Artificial Sequence
  Description of Artificial Sequence: Synthetic peptide
LKEHGSH

SEQ ID NO: 1615 - protein, 7 aa, Artificial Sequence
  Description of Artificial Sequence: Synthetic peptide
YWDWTKS

SEQ ID NO: 1616 - protein, 7 aa, Artificial Sequence
  Description of Artificial Sequence: Synthetic peptide
IAGPTKD

SEQ ID NO: 1617 - protein, 18 aa, Artificial Sequence
  Description of Artificial Sequence: Synthetic peptide
GFTDPPVKHHQSANLLVR

SEQ ID NO: 1618 - protein, 8 aa, Artificial Sequence
  Description of Artificial Sequence: Synthetic peptide
KNINDLTR

SEQ ID NO: 1619 - protein, 10 aa, Artificial Sequence
  Description of Artificial Sequence: Synthetic peptide
EAFHKFQEDR

SEQ ID NO: 1620 - protein, 9 aa, Artificial Sequence
  Description of Artificial Sequence: Synthetic peptide
CPRPDAKDR

SEQ ID NO: 1621 - protein, 8 aa, Artificial Sequence
  Description of Artificial Sequence: Synthetic peptide
VKFDKVPR

SEQ ID NO: 1622 - protein, 5 aa, Artificial Sequence
  Description of Artificial Sequence: Synthetic peptide
KNVDR

SEQ ID NO: 1623 - protein, 10 aa, Artificial Sequence
  Description of Artificial Sequence: Synthetic peptide
KALALLKEDK

SEQ ID NO: 1624 - protein, 19 aa, Artificial Sequence
  Description of Artificial Sequence: Synthetic peptide
EDKSAGGFQQLGAFHGEPK

SEQ ID NO: 1625 - protein, 25 aa, Artificial Sequence
  Description of Artificial Sequence: Synthetic peptide
SAGGFQQLGAFHGEPKWCPSPEASK

SEQ ID NO: 1626 - protein, 18 aa, Artificial Sequence
  Description of Artificial Sequence: Synthetic peptide
HNPWFDGHIDTVDKTTTR

SEQ ID NO: 1627 - protein, 20 aa, Artificial Sequence
  Description of Artificial Sequence: Synthetic peptide
SVQNKLFEQPEFGHYTSIAK

SEQ ID NO: 1628 - protein, 12 aa, Artificial Sequence
  Description of Artificial Sequence: Synthetic peptide
IWAIWQALQKYR

SEQ ID NO: 1629 - protein, 15 aa, Artificial Sequence
  Description of Artificial Sequence: Synthetic peptide
GKPYNVANCAVTSMR

SEQ ID NO: 1630 - protein, 6 aa, Artificial Sequence
  Description of Artificial Sequence: Synthetic peptide
KLEAIK

SEQ ID NO: 1631 - protein, 9 aa, Artificial Sequence
  Description of Artificial Sequence: Synthetic peptide
LEAIKSQDR

SEQ ID NO: 1632 - protein, 6 aa, Artificial Sequence
  Description of Artificial Sequence: Synthetic peptide
KSSLVK

SEQ ID NO: 1633 - protein, 13 aa, Artificial Sequence
  Description of Artificial Sequence: Synthetic peptide
DLFKQPSVIHEPR

SEQ ID NO: 1634 - protein, 15 aa, Artificial Sequence
  Description of Artificial Sequence: Synthetic peptide
KNIENLSLGELESLR

SEQ ID NO: 1635 - protein, 13 aa, Artificial Sequence
  Description of Artificial Sequence: Synthetic peptide
LYVVVVENALLKK

SEQ ID NO: 1636 - protein, 23 aa, Artificial Sequence
  Description of Artificial Sequence: Synthetic peptide
QHHYETNPFHHGKITHENEITTR

SEQ ID NO: 1637 - protein, 5 aa, Artificial Sequence
  Description of Artificial Sequence: Synthetic peptide
KRPYR

SEQ ID NO: 1638 - protein, 9 aa, Artificial Sequence
  Description of Artificial Sequence: Synthetic peptide
KDITQLDKR

SEQ ID NO: 1639 - protein, 17 aa, Artificial Sequence
  Description of Artificial Sequence: Synthetic peptide
KHGAVVGLPYWDWTLPR

SEQ ID NO: 1640 - protein, 12 aa, Artificial Sequence
  Description of Artificial Sequence: Synthetic peptide
IEFEGENVHTKR

SEQ ID NO: 1641 - protein, 12 aa, Artificial Sequence
  Description of Artificial Sequence: Synthetic peptide
LYKYDITETLDK

SEQ ID NO: 1642 - protein, 10 aa, Artificial Sequence
  Description of Artificial Sequence: Synthetic peptide
NKVMPNPFAR

SEQ ID NO: 1643 - protein, 10 aa, Artificial Sequence
  Description of Artificial Sequence: Synthetic peptide
EIKDKQHHVR

SEQ ID NO: 1644 - protein, 29 aa, Artificial Sequence
  Description of Artificial Sequence: Synthetic peptide
TSADVQFQICKTSEDCHHGGQIFVLGGTK

SEQ ID NO: 1645 - protein, 16 aa, Artificial Sequence
  Description of Artificial Sequence: Synthetic peptide
LYTKQMEDALTAHGAR

SEQ ID NO: 1646 - protein, 9 aa, Artificial Sequence
  Description of Artificial Sequence: Synthetic peptide
DKLFNDPER

SEQ ID NO: 1647 - protein, 30 aa, Artificial Sequence; identical to SEQ ID NO: 202
  Description of Artificial Sequence: Synthetic polypeptide

SEQ ID NO: 1648 - protein, 8 aa, Artificial Sequence
  Description of Artificial Sequence: Synthetic peptide
KLEHELEK

SEQ ID NO: 1649 - protein, 6 aa, Artificial Sequence
  Description of Artificial Sequence: Synthetic peptide
QKEEDR

SEQ ID NO: 1650 - protein, 16 aa, Artificial Sequence
  Description of Artificial Sequence: Synthetic peptide
HHEKHHEDHHEDILVR

SEQ ID NO: 1651 - protein, 15 aa, Artificial Sequence
  Description of Artificial Sequence: Synthetic peptide
KNIHSLSHHEAEELR

SEQ ID NO: 1652 - protein, 33 aa, Artificial Sequence; identical to SEQ ID NO: 13
  Description of Artificial Sequence: Synthetic polypeptide

SEQ ID NO: 1653 - protein, 23 aa, Artificial Sequence
  Description of Artificial Sequence: Synthetic peptide
FNYKYDNLNLHGHNIEELEEVLR

SEQ ID NO: 1654 - protein, 19 aa, Artificial Sequence
  Description of Artificial Sequence: Synthetic peptide
KYDHTELDASVLPAPIIVR

SEQ ID NO: 1655 - protein, 29 aa, Artificial Sequence
  Description of Artificial Sequence: Synthetic peptide
KGFTDPPVKHHQSANLLVRKNINDLTREE

SEQ ID NO: 1656 - protein, 29 aa, Artificial Sequence
  Description of Artificial Sequence: Synthetic peptide
KGFTDPPVKHHQSANLLVRKNINDLTREE

SEQ ID NO: 1657 - protein, 12 aa, Artificial Sequence
  Description of Artificial Sequence: Synthetic peptide
AFHKFQEDRSVD

SEQ ID NO: 1658 - protein, 8 aa, Artificial Sequence
  Description of Artificial Sequence: Synthetic peptide
NIEKMIHE

SEQ ID NO: 1659 - protein, 19 aa, Artificial Sequence
  Description of Artificial Sequence: Synthetic peptide
VDGTKLASSLIPHASVIRE

SEQ ID NO: 1660 - protein, 24 aa, Artificial Sequence
  Description of Artificial Sequence: Synthetic peptide
DKSAGGFQQLGAFHGEPKWCPSPE

SEQ ID NO: 1661 - protein, 17 aa, Artificial Sequence
  Description of Artificial Sequence: Synthetic peptide
HSVPFNVFDYKTNFNYE

SEQ ID NO: 1662 - protein, 14 aa, Artificial Sequence
  Description of Artificial Sequence: Synthetic peptide
FNGLSISQLNKKLE

SEQ ID NO: 1663 - protein, 29 aa, Artificial Sequence
  Description of Artificial Sequence: Synthetic peptide
VFDLKPASLGKDLFKQPSVIHEPRIGHHE

SEQ ID NO: 1664 - protein, 14 aa, Artificial Sequence
  Description of Artificial Sequence: Synthetic peptide
TNPFHHGKITHENE

SEQ ID NO: 1665 - protein, 21 aa, Artificial Sequence
  Description of Artificial Sequence: Synthetic peptide
AGTDSAHTDDGHTEPVMIRKD

SEQ ID NO: 1666 - protein, 17 aa, Artificial Sequence
  Description of Artificial Sequence: Synthetic peptide
ITQLDKRQQLSLVKALE

SEQ ID NO: 1667 - protein, 17 aa, Artificial Sequence
  Description of Artificial Sequence: Synthetic peptide
ITQLDKRQQLSLVKALE

SEQ ID NO: 1668 - protein, 28 aa, Artificial Sequence
  Description of Artificial Sequence: Synthetic peptide
LLTVSTIHDPETGRDIPNPFIGSKIEFE

SEQ ID NO: 1669 - protein, 11 aa, Artificial Sequence
  Description of Artificial Sequence: Synthetic peptide
TLDKMNLRHDE

SEQ ID NO: 1670 - protein, 12 aa, Artificial Sequence
  Description of Artificial Sequence: Synthetic peptide
IGGMNLHEIEKE

SEQ ID NO: 1671 - protein, 23 aa, Artificial Sequence
  Description of Artificial Sequence: Synthetic peptide
KHHEDHHEDILVRKNIHSLSHHE

SEQ ID NO: 1672 - protein, 15 aa, Artificial Sequence
  Description of Artificial Sequence: Synthetic peptide
AEELRDALYKLQNDE

SEQ ID NO: 1673 - protein, 8 aa, Artificial Sequence
  Description of Artificial Sequence: Synthetic peptide
LGKMYSVE

SEQ ID NO: 1674 - protein, 10 aa, Artificial Sequence
  Description of Artificial Sequence: Synthetic peptide
VLGGPSEMKW

SEQ ID NO: 1675 - protein, 18 aa, Artificial Sequence
  Description of Artificial Sequence: Synthetic peptide
HKFQEDRSVDGYQATAEY

SEQ ID NO: 1676 - protein, 9 aa, Artificial Sequence
  Description of Artificial Sequence: Synthetic peptide
KEDKSAGGF

SEQ ID NO: 1677 - protein, 9 aa, Artificial Sequence
  Description of Artificial Sequence: Synthetic peptide
TSIAKQVLL

SEQ ID NO: 1678 - protein, 6 aa, Artificial Sequence
  Description of Artificial Sequence: Synthetic peptide
QALQKY

SEQ ID NO: 1679 - protein, 9 aa, Artificial Sequence
  Description of Artificial Sequence: Synthetic peptide
NVFDYKTNF

SEQ ID NO: 1680 - protein, 9 aa, Artificial Sequence
  Description of Artificial Sequence: Synthetic peptide
EAIKSQDRF

SEQ ID NO: 1681 - protein, 12 aa, Artificial Sequence
  Description of Artificial Sequence: Synthetic peptide
DLKPASLGKDLF

SEQ ID NO: 1682 - protein, 8 aa, Artificial Sequence
  Description of Artificial Sequence: Synthetic peptide
KLDITKAL

SEQ ID NO: 1683 - protein, 16 aa, Artificial Sequence
  Description of Artificial Sequence: Synthetic peptide
HALPPLCPSPAASKRF

SEQ ID NO: 1684 - protein, 7 aa, Artificial Sequence
  Description of Artificial Sequence: Synthetic peptide
VGGKEPY

SEQ ID NO: 1685 - protein, 10 aa, Artificial Sequence
  Description of Artificial Sequence: Synthetic peptide
SERDIGSLKY

SEQ ID NO: 1686 - protein, 7 aa, Artificial Sequence
  Description of Artificial Sequence: Synthetic peptide
KYELLGY

SEQ ID NO: 1687 - protein, 13 aa, Artificial Sequence
  Description of Artificial Sequence: Synthetic peptide
THSNAKPTDVFEY

SEQ ID NO: 1688 - protein, 11 aa, Artificial Sequence
  Description of Artificial Sequence: Synthetic peptide
KLQNDESHGGY

SEQ ID NO: 1689 - protein, 8 aa, Artificial Sequence
  Description of Artificial Sequence: Synthetic peptide
GGAKEMPW

SEQ ID NO: 1690 - protein, 9 aa, Artificial Sequence
  Description of Artificial Sequence: Synthetic peptide
MTPEELKTY

SEQ ID NO: 1691 - protein, 19 aa, Artificial Sequence
  Description of Artificial Sequence: Synthetic peptide
VCIPDDNDRNDDHCEKAGD

SEQ ID NO: 1692 - protein, 11 aa, Artificial Sequence
  Description of Artificial Sequence: Synthetic peptide
VLGGPSEMKWQ

SEQ ID NO: 1693 - protein, 7 aa, Artificial Sequence
  Description of Artificial Sequence: Synthetic peptide
LSDTVHK

SEQ ID NO: 1694 - protein, 7 aa, Artificial Sequence
  Description of Artificial Sequence: Synthetic peptide
VHHPEKG

SEQ ID NO: 1695 - protein, 9 aa, Artificial Sequence
  Description of Artificial Sequence: Synthetic peptide
ISLENIEKM

SEQ ID NO: 1696 - protein, 10 aa, Artificial Sequence
  Description of Artificial Sequence: Synthetic peptide
VDITEVDGTK

SEQ ID NO: 1697 - protein, 7 aa, Artificial Sequence
  Description of Artificial Sequence: Synthetic peptide
LLKEDKS

SEQ ID NO: 1698 - protein, 12 aa, Artificial Sequence
  Description of Artificial Sequence: Synthetic peptide
FHGEPKWCPSPE

SEQ ID NO: 1699 - protein, 7 aa, Artificial Sequence
  Description of Artificial Sequence: Synthetic peptide
LADHEKY

SEQ ID NO: 1700 - protein, 7 aa, Artificial Sequence
  Description of Artificial Sequence: Synthetic peptide
VFDYKTN

SEQ ID NO: 1701 - protein, 14 aa, Artificial Sequence
  Description of Artificial Sequence: Synthetic peptide
FDKSDNNDEATKTH

SEQ ID NO: 1702 - protein, 8 aa, Artificial Sequence
  Description of Artificial Sequence: Synthetic peptide
VGGKEPYG

SEQ ID NO: 1703 - protein, 12 aa, Artificial Sequence
  Description of Artificial Sequence: Synthetic peptide
FSKPEDTFDYQK

SEQ ID NO: 1704 - protein, 12 aa, Artificial Sequence
  Description of Artificial Sequence: Synthetic peptide
FSKPEDTFDYQK

SEQ ID NO: 1705 - protein, 9 aa, Artificial Sequence
  Description of Artificial Sequence: Synthetic peptide
VLGGEKEMP

SEQ ID NO: 1706 - protein, 11 aa, Artificial Sequence
  Description of Artificial Sequence: Synthetic peptide
VAVPYWDWTKP

SEQ ID NO: 1707 - protein, 5 aa, Artificial Sequence
  Description of Artificial Sequence: Synthetic peptide
FTKKH

SEQ ID NO: 1708 - protein, 7 aa, Artificial Sequence
  Description of Artificial Sequence: Synthetic peptide
LHEIEKE

SEQ ID NO: 1709 - protein, 13 aa, Artificial Sequence
  Description of Artificial Sequence: Synthetic peptide
ICKTSEDCHHGGQ

SEQ ID NO: 1710 - protein, 11 aa, Artificial Sequence
  Description of Artificial Sequence: Synthetic peptide
LTTAEVDNLKD

SEQ ID NO: 1711 - protein, 11 aa, Artificial Sequence
  Description of Artificial Sequence: Synthetic peptide
AKPTDVFEYSR

SEQ ID NO: 1712 - protein, 10 aa, Artificial Sequence
  Description of Artificial Sequence: Synthetic peptide
LEKQKEEDRT

SEQ ID NO: 1713 - protein, 10 aa, Artificial Sequence
  Description of Artificial Sequence: Synthetic peptide
LEKQKEEDRT

SEQ ID NO: 1714 - protein, 12 aa, Artificial Sequence
  Description of Artificial Sequence: Synthetic peptide
IIDTSGKQLPSD

SEQ ID NO: 1715 - protein, 6 aa, Artificial Sequence
  Description of Artificial Sequence: Synthetic peptide
LIKMPT

SEQ ID NO: 1716 - protein, 6 aa, Artificial Sequence
  Description of Artificial Sequence: Synthetic peptide
IFQQTK

SEQ ID NO: 1717 - protein, 9 aa, Artificial Sequence
  Description of Artificial Sequence: Synthetic peptide
LIGGAEKYS

SEQ ID NO: 1718 - protein, 15 aa, Artificial Sequence
  Description of Artificial Sequence: Synthetic peptide
IKSGTDSDDEYAGSF

SEQ ID NO: 1719 - protein, 7 aa, Artificial Sequence
  Description of Artificial Sequence: Synthetic peptide
LTDDHVK

SEQ ID NO: 1720 - protein, 16 aa, Artificial Sequence
  Description of Artificial Sequence: Synthetic peptide
KNVDSLSSDEVLALEK

SEQ ID NO: 1721 - protein, 9 aa, Artificial Sequence
  Description of Artificial Sequence: Synthetic peptide
ADITFLNKK

SEQ ID NO: 1722 - protein, 12 aa, Artificial Sequence
  Description of Artificial Sequence: Synthetic peptide
LFEKVQPGHHTR

SEQ ID NO: 1723 - protein, 23 aa, Artificial Sequence
  Description of Artificial Sequence: Synthetic peptide
GKDPNSADCAHNLIHTPMEPFDR

SEQ ID NO: 1724 - protein, 13 aa, Artificial Sequence
  Description of Artificial Sequence: Synthetic peptide
EHAKPADSFDYGR

SEQ ID NO: 1725 - protein, 28 aa, Artificial Sequence
  Description of Artificial Sequence: Synthetic peptide
QPTLVHRPAKGHFDKPPVPVAQANLAVR

SEQ ID NO: 1726 - protein, 18 aa, Artificial Sequence
  Description of Artificial Sequence: Synthetic peptide
GHFDKPPVPVAQANLAVR

SEQ ID NO: 1727 - protein, 22 aa, Artificial Sequence
  Description of Artificial Sequence: Synthetic peptide
FQNDKSVDGYQATVEFHALPAR

SEQ ID NO: 1728 - protein, 9 aa, Artificial Sequence
  Description of Artificial Sequence: Synthetic peptide
CPRPDAKDR

SEQ ID NO: 1729 - protein, 15 aa, Artificial Sequence
  Description of Artificial Sequence: Synthetic peptide
KHGFTGGLPYWDWTR

SEQ ID NO: 1730 - protein, 15 aa, Artificial Sequence
  Description of Artificial Sequence: Synthetic peptide
GKPYNTANCAIASMR

SEQ ID NO: 1731 - protein, 19 aa, Artificial Sequence
  Description of Artificial Sequence: Synthetic peptide
KPLQPFGLDSVINPDDETR

SEQ ID NO: 1732 - protein, 27 aa, Artificial Sequence
  Description of Artificial Sequence: Synthetic peptide
VFDYKNNFDYEYESLAFNGLSIAQLDR

SEQ ID NO: 1733 - protein, 17 aa, Artificial Sequence
  Description of Artificial Sequence: Synthetic peptide
SAFLQIQKEGIYENIAK

SEQ ID NO: 1734 - protein, 31 aa, Artificial Sequence; identical to SEQ ID NO: 25
  Description of Artificial Sequence: Synthetic polypeptide

SEQ ID NO: 1735 - protein, 42 aa, Artificial Sequence; identical to SEQ ID NO: 308
  Description of Artificial Sequence: Synthetic polypeptide

SEQ ID NO: 1736 - protein, 26 aa, Artificial Sequence
  Description of Artificial Sequence: Synthetic peptide
AKYSLSSLDYTAFDPVFFLHHANVDR

SEQ ID NO: 1737 - protein, 15 aa, Artificial Sequence
  Description of Artificial Sequence: Synthetic peptide
KKPYNEADCAVNEMR

SEQ ID NO: 1738 - protein, 23 aa, Artificial Sequence
  Description of Artificial Sequence: Synthetic peptide
YQYDNLQFNHFSIQKLDQTIQAR

SEQ ID NO: 1739 - protein, 12 aa, Artificial Sequence
  Description of Artificial Sequence: Synthetic peptide
LYKFDITSALHK

SEQ ID NO: 1740 - protein, 15 aa, Artificial Sequence
  Description of Artificial Sequence: Synthetic peptide
KEVSSLTTLEKHFLR

SEQ ID NO: 1741 - protein, 15 aa, Artificial Sequence
  Description of Artificial Sequence: Synthetic peptide
TQEFSKPEDTFDYHR

SEQ ID NO: 1742 - protein, 5 aa, Artificial Sequence
  Description of Artificial Sequence: Synthetic peptide
KSQTR

SEQ ID NO: 1743 - protein, 15 aa, Artificial Sequence
  Description of Artificial Sequence: Synthetic peptide
KDVTSLTASEIENLR

SEQ ID NO: 1744 - protein, 12 aa, Artificial Sequence
  Description of Artificial Sequence: Synthetic peptide
IWAIWQALQKYR

SEQ ID NO: 1745 - protein, 10 aa, Artificial Sequence
  Description of Artificial Sequence: Synthetic peptide
QPLKPFSESR

SEQ ID NO: 1746 - protein, 9 aa, Artificial Sequence
  Description of Artificial Sequence: Synthetic peptide
KALDDLQQD

SEQ ID NO: 1747 - protein, 12 aa, Artificial Sequence
  Description of Artificial Sequence: Synthetic peptide
KVQPGHHTRLME

SEQ ID NO: 1748 - protein, 5 aa, Artificial Sequence
  Description of Artificial Sequence: Synthetic peptide
RAAKE

SEQ ID NO: 1749 - protein, 24 aa, Artificial Sequence
  Description of Artificial Sequence: Synthetic peptide
KPPVPVAQANLAVRKNINDLTAEE

SEQ ID NO: 1750 - protein, 16 aa, Artificial Sequence
  Description of Artificial Sequence: Synthetic peptide
RFQNDKSVDGYQATVE

SEQ ID NO: 1751 - protein, 19 aa, Artificial Sequence
  Description of Artificial Sequence: Synthetic peptide
HSVPFRVFDYKNNFDYEYE

SEQ ID NO: 1752 - protein, 21 aa, Artificial Sequence
  Description of Artificial Sequence: Synthetic peptide
ITQQLHDLDLHVGDNFFLKYE

SEQ ID NO: 1753 - protein, 12 aa, Artificial Sequence
  Description of Artificial Sequence: Synthetic peptide
SIRSAFLQIQKE

SEQ ID NO: 1754 - protein, 13 aa, Artificial Sequence
  Description of Artificial Sequence: Synthetic peptide
NIAKFHGKPGLCE

SEQ ID NO: 1755 - protein, 13 aa, Artificial Sequence
  Description of Artificial Sequence: Synthetic peptide
NIAKFHGKPGLCE

SEQ ID NO: 1756 - protein, 25 aa, Artificial Sequence
  Description of Artificial Sequence: Synthetic peptide
RGSAVAVPYWDWTEKADSLPSLIND

SEQ ID NO: 1757 - protein, 20 aa, Artificial Sequence
  Description of Artificial Sequence: Synthetic peptide
NAVTSRDPQPELWDNKDFYE

SEQ ID NO: 1758 - protein, 16 aa, Artificial Sequence
  Description of Artificial Sequence: Synthetic peptide
FSKPEDTFDYHRFGYE

SEQ ID NO: 1759 - protein, 18 aa, Artificial Sequence
  Description of Artificial Sequence: Synthetic peptide
FVGMSVSSLHNYIKQQQE

SEQ ID NO: 1760 - protein, 10 aa, Artificial Sequence
  Description of Artificial Sequence: Synthetic peptide
TDAPFFIKVE

SEQ ID NO: 1761 - protein, 20 aa, Artificial Sequence
  Description of Artificial Sequence: Synthetic peptide
LDHAYSLRDGHYYIAGPTKD

SEQ ID NO: 1762 - protein, 20 aa, Artificial Sequence
  Description of Artificial Sequence: Synthetic peptide
DLTREHAKPADSFDYGRLGY

SEQ ID NO: 1763 - protein, 7 aa, Artificial Sequence
  Description of Artificial Sequence: Synthetic peptide
VGGSEKY

SEQ ID NO: 1764 - protein, 9 aa, Artificial Sequence
  Description of Artificial Sequence: Synthetic peptide
TDIAKQVLL

SEQ ID NO: 1765 - protein, 6 aa, Artificial Sequence
  Description of Artificial Sequence: Synthetic peptide
QALQKY

SEQ ID NO: 1766 - protein, 9 aa, Artificial Sequence
  Description of Artificial Sequence: Synthetic peptide
LQIQKEGIY

SEQ ID NO: 1767 - protein, 18 aa, Artificial Sequence
  Description of Artificial Sequence: Synthetic peptide
ICVEQGGEQNCKTKAGSF

SEQ ID NO: 1768 - protein, 7 aa, Artificial Sequence
  Description of Artificial Sequence: Synthetic peptide
TTLEKHF

SEQ ID NO: 1769 - protein, 15 aa, Artificial Sequence
  Description of Artificial Sequence: Synthetic peptide
KPQSALPDLVTQETY

SEQ ID NO: 1770 - protein, 9 aa, Artificial Sequence
  Description of Artificial Sequence: Synthetic peptide
SHKTFPNPF

SEQ ID NO: 1771 - protein, 11 aa, Artificial Sequence
  Description of Artificial Sequence: Synthetic peptide
IKQQQEADRVF

SEQ ID NO: 1772 - protein, 11 aa, Artificial Sequence
  Description of Artificial Sequence: Synthetic peptide
KGFGQSASVSF

SEQ ID NO: 1773 - protein, 8 aa, Artificial Sequence
  Description of Artificial Sequence: Synthetic peptide
KYDITQAL

SEQ ID NO: 1774 - protein, 17 aa, Artificial Sequence
  Description of Artificial Sequence: Synthetic peptide
KAQSIHPEDVFDTDAPF

SEQ ID NO: 1775 - protein, 7 aa, Artificial Sequence
  Description of Artificial Sequence: Synthetic peptide
KQPLKPF

SEQ ID NO: 1776 - protein, 8 aa, Artificial Sequence
  Description of Artificial Sequence: Synthetic peptide
RYDITKVL

SEQ ID NO: 1777 - protein, 8 aa, Artificial Sequence
  Description of Artificial Sequence: Synthetic peptide
TSANVKIY

SEQ ID NO: 1778 - protein, 8 aa, Artificial Sequence
  Description of Artificial Sequence: Synthetic peptide
IAGPTKDL

SEQ ID NO: 1779 - protein, 7 aa, Artificial Sequence
  Description of Artificial Sequence: Synthetic peptide
VDKHEKN

SEQ ID NO: 1780 - protein, 11 aa, Artificial Sequence
  Description of Artificial Sequence: Synthetic peptide
FEKVQPGHHTR

SEQ ID NO: 1781 - protein, 11 aa, Artificial Sequence
  Description of Artificial Sequence: Synthetic peptide
LDALEQDEFCK

SEQ ID NO: 1782 - protein, 11 aa, Artificial Sequence
  Description of Artificial Sequence: Synthetic peptide
LRGKDPNSADC

SEQ ID NO: 1783 - protein, 16 aa, Artificial Sequence
  Description of Artificial Sequence: Synthetic peptide
LTREHAKPADSFDYGR

SEQ ID NO: 1784 - protein, 8 aa, Artificial Sequence
  Description of Artificial Sequence: Synthetic peptide
LGGPTEMK

SEQ ID NO: 1785 - protein, 7 aa, Artificial Sequence
  Description of Artificial Sequence: Synthetic peptide
FDKPPVP

SEQ ID NO: 1786 - protein, 8 aa, Artificial Sequence
  Description of Artificial Sequence: Synthetic peptide
VGGSEKYS

SEQ ID NO: 1787 - protein, 12 aa, Artificial Sequence
  Description of Artificial Sequence: Synthetic peptide
FHGEPKWCPSPE

SEQ ID NO: 1788 - protein, 7 aa, Artificial Sequence
  Description of Artificial Sequence: Synthetic peptide
VFDYKNN

SEQ ID NO: 1789 - protein, 6 aa, Artificial Sequence
  Description of Artificial Sequence: Synthetic peptide
LWDNKD

SEQ ID NO: 1790 - protein, 15 aa, Artificial Sequence
  Description of Artificial Sequence: Synthetic peptide
LKHNLPQDSFDYQNR

SEQ ID NO: 1791 - protein, 17 aa, Artificial Sequence
  Description of Artificial Sequence: Synthetic peptide
ICVEQGGEQNCKTKAGS

SEQ ID NO: 1792 - protein, 17 aa, Artificial Sequence
  Description of Artificial Sequence: Synthetic peptide
ICVEQGGEQNCKTKAGS

SEQ ID NO: 1793 - protein, 10 aa, Artificial Sequence
  Description of Artificial Sequence: Synthetic peptide
FSHKTFPNPF

SEQ ID NO: 1794 - protein, 12 aa, Artificial Sequence
  Description of Artificial Sequence: Synthetic peptide
FSKPEDTFDYHR

SEQ ID NO: 1795 - protein, 10 aa, Artificial Sequence
  Description of Artificial Sequence: Synthetic peptide
IKQQQEADRV

SEQ ID NO: 1796 - protein, 7 aa, Artificial Sequence
  Description of Artificial Sequence: Synthetic peptide
YWDWTKP

SEQ ID NO: 1797 - protein, 7 aa, Artificial Sequence
  Description of Artificial Sequence: Synthetic peptide
ISKLPDL

SEQ ID NO: 1798 - protein, 5 aa, Artificial Sequence
  Description of Artificial Sequence: Synthetic peptide
FAKGY

SEQ ID NO: 1799 - protein, 8 aa, Artificial Sequence
  Description of Artificial Sequence: Synthetic peptide
IKSEDAYT

SEQ ID NO: 1800 - protein, 5 aa, Artificial Sequence
  Description of Artificial Sequence: Synthetic peptide
FTKMH

SEQ ID NO: 1801 - protein, 10 aa, Artificial Sequence
  Description of Artificial Sequence: Synthetic peptide
LDEANDLKNA

SEQ ID NO: 1802 - protein, 7 aa, Artificial Sequence
  Description of Artificial Sequence: Synthetic peptide
LKEHGSH

SEQ ID NO: 1803 - protein, 7 aa, Artificial Sequence
  Description of Artificial Sequence: Synthetic peptide
IAGPTKD

What is claimed is:

1. A mixture of compounds, wherein each compound comprises the structure:

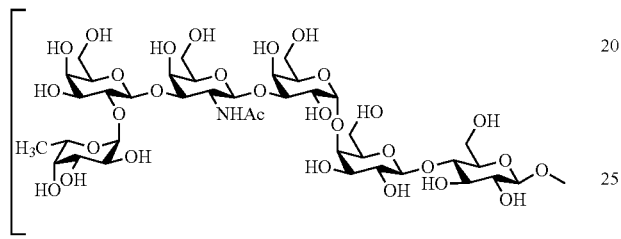

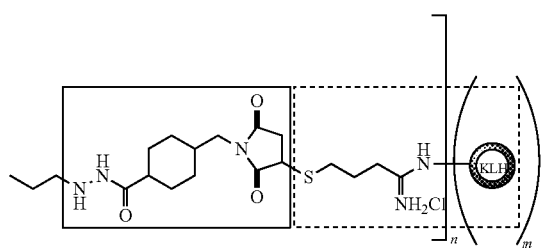

wherein n denotes one or more Globo H moieties and m denotes one or more KLH moieties, wherein the one or more Globo H moieties are covalently linked to the one or more KLH moieties on a basic amino acid residue via a linker as depicted in the structure, and wherein the compound has a glycoconjugate epitope ratio ranging from 900 to 3000;

wherein one or more thiolated KLH moieties are stored under inert gas before being conjugated with the Globo H moieties, wherein the substructure:

represents a KLH moiety subunit, wherein the glycoconjugate epitope ratio is defined as (actual one or more Globo H moieties weight/Globo H molecular weight)/(actual one or more KLH moieties weight/KLH molecular weight), and wherein the KLH moiety subunit comprises a polypeptide having the sequence of SEQ ID NO: 1 or SEQ ID NO: 2.

2. The mixture of claim 1, wherein the majority of the KLH moiety of the compounds is an oligomer.

3. The mixture of claim 2, wherein the majority of the KLH moiety of the compounds is a monomer, a dimer, a trimer, a tetramer, a pentamer, and a hexamer.

4. The mixture of claim 1, wherein the epitope ratio is 1050 to 3000.

5. The mixture of claim 1, wherein the epitope ratio is 1050 to 2250.

6. The mixture of claim 1, wherein the epitope ratio is 1200 to 3000.

7. A pharmaceutical composition comprising the mixture of compounds of claim 1 and a pharmaceutically acceptable carrier.

8. A pharmaceutical composition comprising a mixture of compounds, wherein each compound comprises the structure:

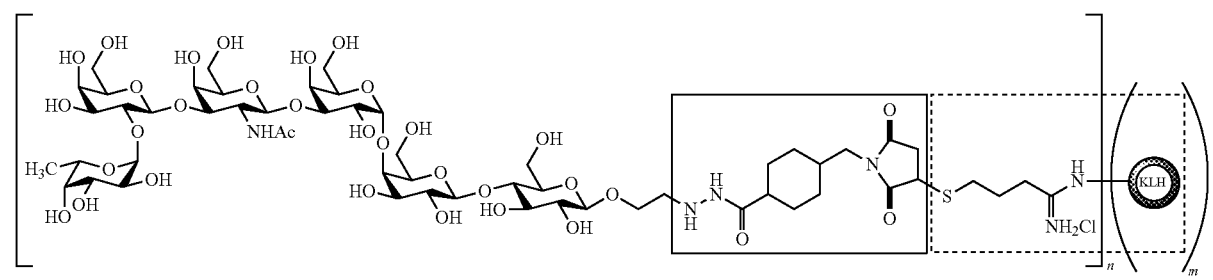

wherein n denotes one or more Globo H moieties and m denotes one or more KLH moieties, wherein the one or more Globo H moieties are covalently linked to the one or more KLH moieties on a basic amino acid residue via a linker as depicted in the structure, and wherein the compound has a glycoconjugate epitope ratio ranging from 900 to 3000;

wherein the majority of the one or more KLH moieties of the compounds are oligomers, wherein the substructure:

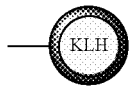

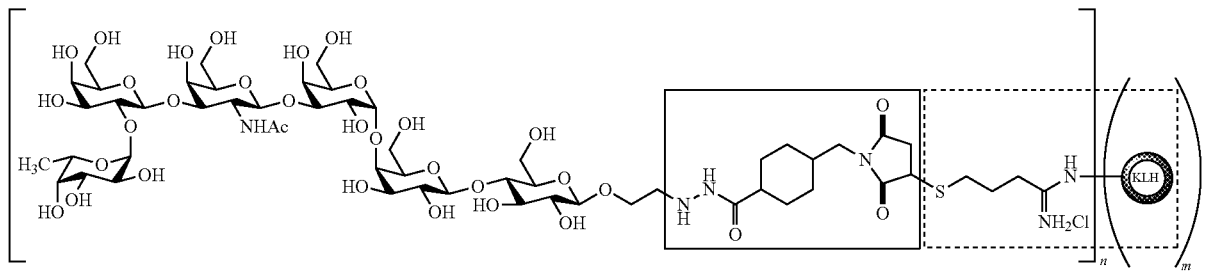

represents a KLH moiety subunit,
  wherein the glycoconjugate epitope ratio is defined as (actual one or more Globo H moieties weight/Globo H molecular weight)/(actual one or more KLH moieties weight/KLH molecular weight),
  wherein the KLH moiety subunit comprise a polypeptide having the sequence of SEQ ID NO: 1 or SEQ ID NO: 2, and
  further comprising an OBI-821 adjuvant.

9. The pharmaceutical composition of claim 8, wherein 1% to 99% of the KLH moieties of the compounds are monomers.

10. The pharmaceutical composition of claim 8, wherein 1% to 99% of the KLH moieties of the compounds are dimers.

11. The pharmaceutical composition of claim 8, wherein 1% to 99% of the KLH moieties of the compounds are trimers.

12. The pharmaceutical composition of claim 8, wherein 1% to 99% of the KLH moieties of the compounds are tetramers.

13. The pharmaceutical composition of claim 8, wherein 1% to 99% of the KLH moieties of the compounds are pentamers.

14. The pharmaceutical composition of claim 8, wherein 1% to 99% of the KLH moieties of the compounds are hexamers.

15. The pharmaceutical composition of claim 8, wherein 80% or more of the KLH moieties of the compounds are monomers, dimers, and trimers.

16. The pharmaceutical composition of claim 8, wherein 90% to 99% f of the KLH moieties of the compounds are monomers, dimers, trimers, tetramers, pentamers, and hexamers.

17. A mixture of glycoconjugate compounds made by a process comprising:
  (a) contacting a KLH protein with a thiolating agent to form thiolated KLH moieties and storing said thiolated KLH moieties under inert gas,
  (b) reacting Globo H aldehyde with the MMCCH linker to form Globo H-MMCCH, and
  (c) contacting the Globo H-MMCCH with the thiolated KLH moieties to form a mixture of glycoconjugate compounds, wherein each glycoconjugate comprises the structure:

wherein n denotes one or more Globo H moieties and m denotes one or more KLH moieties,
wherein the one or more Globo H moieties are covalently linked to the one or more KLH moieties on a basic amino acid residue via a linker as depicted in the structure, and wherein the compound has a glycoconjugate epitope ratio ranging from 900 to 3000;
wherein the structure:

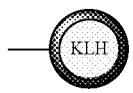

represents a KLH moiety subunit,
  wherein the glycoconjugate epitope ratio is defined as (actual one or more Globo H moieties weight/Globo H molecular weight)/(actual one or more KLH moieties weight/KLH molecular weight), and
  wherein the KLH moiety subunit comprises a polypeptide having the sequence of SEQ ID NO: 1 or SEQ ID NO: 2.

18. The mixture of glycoconjugate compounds of claim 17, wherein the thiolating agent is 2-iminothiolane.

19. The mixture of glycoconjugate compounds of claim 17, wherein step (b) is performed in the presence of a reducing agent.

20. The mixture of glycoconjugate compound of claim 19, wherein the reducing agent is NaCNBH$_3$.

21. The mixture of glycoconjugate compound of claim 17, wherein the Globo H-aldehyde of step (b) is obtained from the ozonolysis of Globo H allyl glycoside.

22. The mixture of glycoconjugate compound of claim 17, wherein the inert gas is selected from nitrogen or argon.

23. The pharmaceutical composition of claim 7, further comprising an adjuvant.

24. The pharmaceutical composition of claim 23, wherein the adjuvant is OBI-821.

25. A mixture of glycoconjugate compounds made by a process comprising:

(a) contacting a KLH protein with a thiolating agent to form thiolated KLH moieties and storing said thiolated KLH moieties under inert gas, (b) reacting Globo H aldehyde with the MMCCH linker to form Globo H-MMCCH, and (c) contacting the Globo H-MMCCH with the thiolated KLH moieties to form a mixture of glycoconjugate compounds, wherein each glycoconjugate comprises the structure:

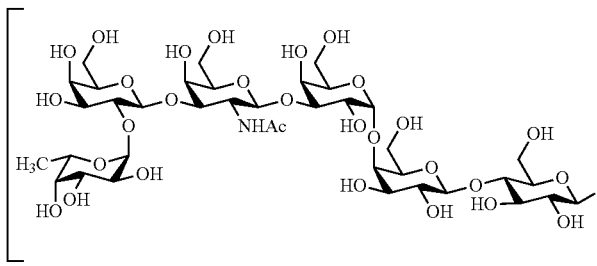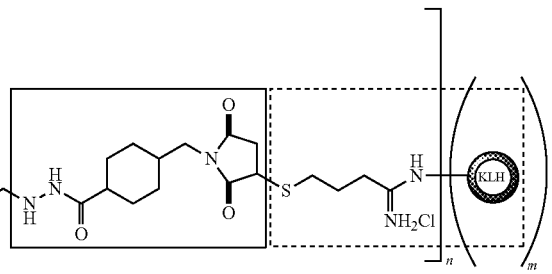

wherein n denotes one or more Globo H moieties and m denotes one or more KLH moieties,
wherein the one or more Globo H moieties are covalently linked to the one or more KLH moieties on a basic amino acid residue via a linker as depicted in the structure, and wherein the compound has a glycoconjugate epitope ratio ranging from 900 to 3000;
wherein the structure:

represents a KLH moiety subunit,
wherein the glycoconjugate epitope ratio is defined as (actual one or more Globo H moieties weight/Globo H molecular weight)/(actual one or more KLH moieties weight/KLH molecular weight),
wherein the KLH moiety subunit comprises a polypeptide having the sequence of SEQ ID NO: 1 or SEQ ID NO: 2, and
wherein the reducing agent is NaCNBH$_3$.

* * * * *